US007094411B2

(12) United States Patent
Kinney et al.

(10) Patent No.: US 7,094,411 B2
(45) Date of Patent: Aug. 22, 2006

(54) AVIRULENT, IMMUNOGENIC FLAVIVIRUS CHIMERAS

(75) Inventors: Richard M. Kinney, Fort Collins, CO (US); Claire Y. H. Kinney, Fort Collins, CO (US); Duane J. Gubler, Fort Collins, CO (US); Siritorn Butrapet, Bangkok (TH); Natth Bhamarapravati, Bangkok (TH)

(73) Assignee: The United States of America as represented by the Department of Health and Human Services, Washington, DC (US)

( * ) Notice: Subject to any disclaimer, the term of this patent is extended or adjusted under 35 U.S.C. 154(b) by 85 days.

(21) Appl. No.: 10/204,252

(22) PCT Filed: Feb. 16, 2001

(86) PCT No.: PCT/US01/05142

§ 371 (c)(1),
(2), (4) Date: Jan. 29, 2003

(87) PCT Pub. No.: WO01/60847

PCT Pub. Date: Aug. 23, 2001

(65) Prior Publication Data

US 2006/0062803 A1    Mar. 23, 2006

Related U.S. Application Data

(60) Provisional application No. 60/182,829, filed on Feb. 16, 2000.

(51) Int. Cl.
*A61K 39/12*    (2006.01)
*A61K 35/00*    (2006.01)
*A61K 39/295*    (2006.01)
*C07K 14/18*    (2006.01)
*C12N 15/63*    (2006.01)
*C12N 15/11*    (2006.01)
*C12N 15/14*    (2006.01)
*C12N 15/09*    (2006.01)
*C12N 15/10*    (2006.01)
*C07H 21/02*    (2006.01)
*C07H 21/04*    (2006.01)

(52) U.S. Cl. ............ 424/218.1; 536/23.4; 536/23.72; 536/23.1; 435/236; 435/69.2; 435/69.3; 435/69.4; 435/235.1; 424/204.1; 424/205.1; 424/199.1; 424/185.1; 424/186.1; 424/202.1; 514/2

(58) Field of Classification Search ............... 536/23.1, 536/23.4, 23.72; 435/236, 69.1, 69.2, 69.3, 435/69.4, 235.1; 424/218.1, 204.1, 205.1, 424/199.1, 185.1, 186.1, 202.1; 514/2
See application file for complete search history.

(56) References Cited

U.S. PATENT DOCUMENTS

| | | | |
|---|---|---|---|
| 4,810,492 A | 3/1989 | Fujita et al. | 424/88 |
| 5,021,347 A | 6/1991 | Yasui et al. | 435/235 |
| 5,229,293 A | 7/1993 | Matsuura et al. | 435/320.1 |
| 5,494,671 A | 2/1996 | Lai et al. | 424/218.1 |
| 5,514,375 A | 5/1996 | Paoletti et al. | 424/199.1 |
| 6,165,477 A | 12/2000 | Ivy et al. | 424/218.1 |
| 6,184,024 B1 * | 2/2001 | Lai et al. | 435/235.1 |

FOREIGN PATENT DOCUMENTS

| | | |
|---|---|---|
| JP | 5276941 | 10/1993 |
| WO | WO 90/01946 | 3/1990 |
| WO | WO 92/03545 | 3/1992 |
| WO | WO 93/06214 | 1/1993 |
| WO | WO 9640933 A1 * | 12/1996 |
| WO | WO 98/37911 | 9/1998 |
| WO | WO 99/63095 | 12/1999 |
| WO | WO 02/072036 | 9/2002 |

OTHER PUBLICATIONS

Aberle et al., "A DNA Immunization Model Study with Constructs Expressing the Tick-Borne Encephalitis Virus Envelope Protein E in Different Physical Forms." *J. Immunl.* 163:6756-6761 (1999).

Allison et al., "Synthesis and Secretion of Recombinant Tick-Borne Encephalitis Virus Protein E in Soluble and Particulate Form." *J. Virol.* 69(9): 5816-5820 (Sep. 1995).

Alvarez et al. "A Phase I Study of Recombinant Adenovirus Vector-Mediated Delivery of an Anti-erbB-2 Single-Chain (sFv) Antibody Gene for Previously Treated Ovarian and Extraovarian Cancer Patients." *Hum. Gene Ther.* 8:229-242 (Jan. 20, 1997).

Anderson et al., "Isolation of West Nile Virus from Mosquitoes, Crows, and a Cooper's Hawk in Connecticut." *Science* 286:2331-2333 (Dec. 17, 1999).

Arroyo et al., "Molecular Basis for Attenuation of Neurovirulence of a Yellow Fever Virus/Japanese Encephalitis Virus Chimera Vaccine (ChimeriVax-JE)." *J. Virol.* 75(2):934-942 (Jan. 2001).

(Continued)

*Primary Examiner*—James Housel
*Assistant Examiner*—Bao Qun Li
(74) *Attorney, Agent, or Firm*—Needle & Rosenberg, P.C.

(57) ABSTRACT

Chimeric flaviviruses that are avirulent and immunogenic are provided. The chimeric viruses are constructed to contain amino acid mutations in the nonstructural proteins of a flavivirus. Chimeric viruses containing the attenuation-mutated nonstructural genes of the virus are used as a backbone into which the structural protein genes of a second flavivirus strain are inserted. These chimeric viruses elicit pronounced immunogenicity yet lack the accompanying clinical symptoms of viral disease. The attenuated chimeric viruses are effective as immunogens or vaccines and may be combined in a pharmaceutical composition to confer simultaneous immunity against several strains of pathogenic flaviviruses.

6 Claims, 4 Drawing Sheets

OTHER PUBLICATIONS

Asnis et al., "The West Nile Virus Outbreak of 1999 in New York: The Flushing Hospital Experience." *Clin. Infect. Dis.* 30: 413-418 (2000).

Azevedo et al., "Main features of DNA-based immunization vectors." *Braz. J. Med. Biol. Res.* 32(2):147-153 (1999).

Bhamarapravati et al., "Immunization with a live attenuated dengue-2-virus candidate vaccine (16681-PDK 53): clinical, immunological and biological responses in adult volunteers." *Bull World Health Organ.* 65(2):189-195 (1987).

Bhamarapravati and Yoksan., "Study Of Bivalent Dengue Vaccine In Volunteers." *Lancet* 1:1077 (1989).

Bhamarapravati and Yoksan. "Live attenuated tetravalent vaccine," In *Dengue and Dengue Hemorrhagic Fever*, D. J. Gubler and G. Kuno (ed.),. Cab International, Wallingford, OX, UK p. 367-377 (1997).

Bhamarapravati and Sutee. "Live attenuated tetravalent dengue vaccine." *Vaccine* 18:44-47 (2000).

Bhatt et al., "Growth Characteristics of the Chimeric Japanese Encephalitis Virus Vaccine Candidate, ChimeriVax-JE (YF/JE SA14-14-2), In *Culex tritaeniorhynchus, Aedes albopictus, and Aedes aegypti* Mosquitoes." *Am. J. Trop. Med. Hyg.* 62(4):480-484 (2000).

Blok et al., "Comparison of a Dengue-2 Virus and Its Candidate Vaccine Derivative. Sequence Relationships with the Flaviviruses and Other Viruses." *Virology* 187:573-590 (1992).

Bray et al., "Mice Immunized with Recombinant Vaccinia Virus Expressing Dengue 4 Virus Structural Proteins with or without Nonstructural Protein NS1 Are Protected against Fatal Dengue Virus Encephalitis." *J. Virol.* 63(6): 2853-2856 (Jun. 1989).

Bray et al., "Monkeys Immunized with Intertypic Chemeric Dengue Viruses Are Protected against Wild-Type Virus Challenge." *J. Virol.* 70(6):4162-4166 (Jun. 1996).

Bray and Lai., "Construction of intertypic chimeric dengue viruses by substitution of structural protein genes." *Proc. Natl. Acad. Sci. USA* 88:10342-10346 (Nov. 1991).

Butpret et al., "Attenuation Markers of a Candidate Degue Type 2 Vaccine Virus, Strain 16681 (PDK-53), Are Defined by Mutations in the 5' Noncoding Region and Nonstructural Proteins 1 and 3." *J. Virol.* 74(7):3011-3019 (Apr. 2000).

Butrapet et al., "Chimeric Dengue Type 2/Type 1 Viruses Induce Immune Responses In Cynomolgus Monkeys." *Southeast Asian J. Trop. Med. Public Health* 33(3):589-599 (Sep. 2002).

Cahour et al., "Growth-Restricted Dengue Virus Mutants Containing Deletions in the 5' Noncoding Region of the RNA Genome." *Virology* 207:68-76 (1995).

Chambers et al., "Yellow Fever/Japanese Encephalitis Chimeric Viruses: Construction and Biological Properties." *J. Virol.* 73(4):3095-3101 (Apr. 1999).

Chambers et al., "Flavivirus Genome Organization, Expression, and Replication." *Annu. Rev. Microbiol.* 44:649-688 (1990).

Chambers et al., "Yellow Fever Virus/Dengue-2 Virus and Yellow Fever Virus/Dengue-4 Virus Chimeras: Biological Characterization, Immunogenicity, and Protection against Dengue Encephalitis in the Mouse Model." *J. Virol.* 77(6):3655-3668 (Mar. 2003).

Chang et al., "A Single Intramuscular Injection of Recombinant Plasmid DNA Induces Protective Immunity and Prevents Japanese Encephalitis in Mice." *J. Virol.* 74(9):4244-4252 (May 2000).

Chen et al., "Construction of Intertypic Chimeric Dengue Viruses Exhibiting Type 3 Antigenicity and Neurovirulence for Mice." *J. Virol.* 69(8):5186-5190 (Aug. 1995).

Clarke and Casals. "Techniques For Hemagglutination And Hemagglutination-Inhibition With Arthropod-Borne Viruses." *Am. J. Trop. Med. Hyg.* 7:561-573 (1958).

Davis et al., "West Nile Virus Recombinant DNA Vaccine Protects Mouse and Horse from Virus Challenge and Expresses in Vitro a Noninfectious Recombinant Antigen That Can Be Used in Enzyme-linked Immunosorbent Assays." *J. Virol.* 75(9):4040-4047 (May 2001).

Deubel et al., "Nucleotide Sequence and Deduced Amino Acid Sequence of the Nonstructural Proteins of Dengue Type 2 Virus, Jamaica Genotype: Comparative Analysis of the Full-Length Genome." *Virology* 165:234-244 (1988).

Deubel et al., "Nucleotide Sequence and Deduced Amino Acid Sequence of the Structural Proteins of Dengue Type 2 Virus, Jamaica Genotype." *Virology* 155:365-377 (1986).

Dharakul et al., "Dengue Virus-Specific Memory T Cell Responses in Human Volunteers Receiving a Live Attenuated Dengue Virus Type 2 Candidate Vaccine." *J. Infect. Dis.* 170:27-33 (1994).

Dmitriev et al., "Immunization with recombinant vaccinia viruses expressing structural and part of the nonstructural region of tick-borne encephalitis virus cDNA protect mice against lethal encephalitis." *J. Biotechnol.* 44:97-103 (1996).

Duarte dos Santos et al., "Complete nucleotide sequences of yellow fever virus vaccine strains 17DD and 17D-213." *Virus Res.* 35:35-41 (1995).

Durbin et al., "Attenuation And Immunogenicity In Humans Of A Live Dengue Virus Type-4 Vaccine Candidate With A 30 Nucleotide Detection In Its 3'-Untranslated Region." *Am. J. Trop. Med. Hyg.* 65(5):405-413 (2001).

Falgout et al., "Immunization of Mice with Recombinant Vaccinia Virus Expressing Authentic Dengue Virus Nonstructural Protein NS1 Protects against Lethal Dengue Virus Encephalitis." *J. Virol.* 64(9):4356-4363 (Sep. 1990).

Falgout et al., "Proper Processing of Dengue Virus Nonstructural Glycoprotein NS1 Requires the N-terminal Hydrophobic Signal Sequence and the Downstream Nonstructural Protein NS2a." *J. Virol.* 63(5):1852-1860 (May 1989).

Garmendia et al., "Recovery and Identification of West Nile Virus from a Hawk in Winter." *J. Clin. Microbiol.* 38(8):3110-3111 (Aug. 2000).

Gruenberg et al., "Partial Nucleotide Sequence and Deduced Amino Acid Sequence of the Structural Proteins of Dengue Virus Type 2, New Guinea C and PUO-218 Strains." *J. Gen. Virol.* 69:1391-1398 (1988).

Guirakhoo et al., "Immunogenicity, Genetic Stability, and Protective Efficacy of a Recombinant, Chimeric Yellow Fever-Japanese Encephalitis Virus (ChimeriVax-JE) as a Live, Attenuated Vaccine Candidate against Japanese Encephalitis." *Virology* 257:363-372 (1999).

Guirakhoo et al., "Viremia and Immunogenicity in Nonhuman Primates of a Tetravalent Yellow Fever-Dengue Chimeric Vaccine: Genetic Reconstructions, Dose Adjustment, and Antibody Responses Against Wild-type Dengue Virus Isolates." *Virology* 298:146-159 (2002).

Guriakhoo et al., "Construction, Safety, and Immunogenicity in Nonhuman Primates of a Chimeric Yellow Fever-Dengue Virus Tetravalent Vaccine." *J. Virol.* 75(16):7290-7304 (Aug. 2001).

Hahn et al., "Nucleotide Sequence of Dengue 2 RNA and Comparison of the Encoded Proteins with Those of Other Flaviviruses." *Virology* 162:167-180.

Halstead and Simasthien. "Observations Related To The Pathogenesis Of Dengue Hemorrhagic Fever. II. Antigenic And Biologic Properties Of Dengue Viruses And Their Association With Disease Response In The Host." *Yale J. Biol. Med.* 42:276-292 (Apr. 1970).

Hashimoto et al., "Molecular Cloning and Complete Nucleotide Sequence of the Genome of Japanese Encephalitis Virus Beijing-1 Strain." *Virus Genes* 1(3):305-317 (1988).

Heinz and Roehrig, Flaviviruses. Immunochemistry of Viruses II: The Basis for Serodiagnosis and Vaccines (edited by von Regenmortel and Neurath) Elsevier Science Publishers Chapter 14, pp. 289-305 (1990).

Henchal et al., "Dengue Virus-Specific And Flavivirus Group Determinants Identified With Monoclonal Antibodies By Indirect Immunofluorescence." *Am. J. Trop. Med. Hyg.* 31(4):830-836 (1982).

Hennessy et al., "Effectiveness of live-attenuated Japanese encephalitis vaccine (SA14-14-2): a case-control study." *Lancet* 347:1583-1586 (Jun. 8, 1996).

Ho et al., "DNA vaccination induces a long-term antibody response and protective immunity against pseudorabies virus in mice." *Arch. Virol.* 143:115-125 (1998).

Huang et al., "Chimeric Dengue Type 2 (Vaccine Strain PDK-53)/ Dengue Type 1 Virus as a Potential Candidate Dengue Type 1 Virus Vaccine." *J. Virol.* 74(7):3020-3028 (Apr. 2000).

Hubálek et al., "West Nile Fever-a Reemerging Mosquito-Borne Viral Disease in Europe." *Emerg. Infect. Dis.* 5(5):643-650 (Oct. 1999).

Hunt and Calisher, "Relationships of Bunyamwera Group Viruses by Neutralization." *Am. J. Trop. Med. Hyg.* 28(4):740-749 (1979).

Jia et al., "Genetic analysis of West Nile New York 1999 encephalitis virus." *Lancet* 354:1971-1972 (Dec. 4, 1999).

Jirakanjanakit et al., "Dynamics Of Susceptibility And Transmissibility Of The Live, Attenuated, Candidate Vaccine Dengue-1 PDK-13, Dengue-3 PGK30F3, And Dengue-4 PDK-48 After Oral Infection In *Aedes aegypti*." *Am. J. Trop. Med. Hyg.* 61(4):672-676 (1999).

Johnson et al., "Detection of Anti-Arboviral Immunoglobulin G by Using a Monoclonal Antibody-Based Capture Enzyme-Linked Immunosorbent Assay." *J. Clin. Microbiol.* 38(5):1827-1831 (May 2000).

Johnson et al., "Growth Characteristics Of ChimeriVax-DEN2 Vaccine Virus In *Aedes aegypti* And *Aedes albopictus* Mosquitoes." *Am. J. Trop. Med. Hyg.* 67(3):260-265 (2002).

Kanesa-thasan et al., "Safety and immunogenicity of attenuated dengue virus vaccines (*Aventis pasteur*) in human volunteers." *Vaccine* 19:3179-3188 (2001).

Kawano et al., "Genetic Determinants of Dengue Type 4 Virus Neurovirulence for Mice." *J. Virol.* 67(11):6567-6575 (Nov. 1993).

Khin et al., "Infection, Dissemination, Transmission, And Biological Attributes Of Dengue-2 PDK53 Candidate Vaccine Virus After Oral Infection In *Aedes aegypti*." *Am. J. Trop. Med. Hyg.* 51(6):864-869 (1994).

Kimura-Kuroda et al., "Antigenic Comparison of Envelope Protein E between Japanese Encephalitis Virus and Some Other Flaviviruses Using Monoclonal Antibodies." *J. Gen. Virol.* 67:2663-2672 (1986).

Kimura-Kuroda et al., "Topographical Analysis of Antigenic Determinants on Envelope Glycoprotein V3 (E) of Japanese Encephalitis Virus, Using Monoclonal Antibodies." *J. Virol.* 45(1):124-132 (Jan. 1983).

Kinney et al., "Construction of Infectious cDNA Clones for Dengue 2 Virus: Strain 16681 and Its Attenuated Vaccine Dervative, Strain PDK-53." *Virology* 230(2):300-308 (1997).

Kinney and Huang. "Development of New Vaccines against Dengue Fever and Japanese Encephalitis." *Intervirology* 44:176-197 (2001).

Klinman et al., "CpG motifs as immune adjuvants." *Vaccine* 17:19-25 (1999).

Kochel et al., "Inoculation of plasmids expressing the dengue-2 envelope gene elicit neutralizing antibodies in mice." *Vaccine* 15(5):547-552 (1997).

Kohler et al., "Continuous cultures of fused cells secreting antibody of predefined specificity." *Nature* 256:495-497 (Aug. 7, 1975).

Konishi et al., "Avipox virus-vectored Japanese encephalitis virus vaccines: use as vaccine candidates in combination with purified subunit immunogens." *Vaccine* 12(7):633-638 (1994).

Konishi et al., "Comparison of Protective Immunity Elicited by Recombinant Vaccinia Viruses That Synthesizes E or NS1 of Japanese Encephalitis Virus." *Virology* 185:401-410 (1991).

Konishi et al., "Generation and Characterization of a Mammalian Cell Line Continuously Expressing Japanese Encephalities Virus Subviral Particles." *J. Virol.* 75(5): 2204-2212 (Mar. 2001).

Konishi et al., "Induction of Protective Immunity against Japanese Encephalitis in Mice by Immunization with a Plasmid Encoding Japanese Encephalitis Virus Premembrane and Envelope Genes." *J. Virol.* 72(6):4925-4930 (Jun. 1998).

Konishi et al., "Mice Immunized with a Subviral Particle Containing the Japanese Encephalitis Virus prM/M and E Proteins Are Protected from Lethal JEV Infection." *Virology* 188:714-720 (1992).

Kozak. "Circumstances and Mechanisms of Inhibition of Translation by Secondary Structure in Eucaryotic mRNAs." *Mol. Cell. Biol.* 9(11):5134-5142 (Nov. 1989).

Kuno et al., "Phylogeny of the Genus Flavivirus." *J. Virol.* 72(1):73-83 (Jan. 1998).

Laemmli. "Cleavage of Structural Proteins during the Assembly of the Head of Bacteriophage T4." *Nature* 227:680-685 (Aug. 15, 1970).

Lai et al., "Immunization of Monkeys with Baculovirus Recombinant-expressed Dengue Envelope and NS1 Glycoproteins Induces Partial Resistance to Challenge with Homotypic Dengue Virus." In Vaccines 90: Modern Approaches to New Vaccines including Prevention of AIDS, Cold Spring Harbor Laboratory, Cold Springs Harbor, NY pp. 119-124 (1990).

Lai et al., "Evaluation of molecular strategies to develop a live dengue vaccine." *Clin. Diagn. Virol.* 10:173-179 (1998).

Lanciotti et al., "Origin of the West Nile Virus Responsible for an Outbreak of Encephalitis in the Northeastern United States." *Science* 286:2333-2337 (Dec. 17, 1999).

Llljeström et al., "In vitro Mutagenesis of a Full-Length cDNA Clone of Semliki Forest Virus: the Small 6,000-Molecular-Weight Membrane Protein Modulates Virus Release." *J. Virol.* 65(8):4107-4113 (Aug. 1991).

Lin et al., "DNA Immunization with Japanese Encephalitis Virus Nonstructural Protein NS1 Elicits Protective Immunity in Mice." *J. Virol.* 72(1):191-200 (Jan. 1998).

Mackow et al., "The Nucleotide Sequence of Dengue Type 4 Virus: Analysis of Genes Coding for Nonstructural Proteins." *Virology* 159:217-228 (1987).

Mandl et al., "Complete Genomic Sequence of Powassan Virus: Evaluation of Genetic Elements in Tick-Borne versus Mosquito-Borne Flaviviruses." *Virology* 194:173-184 (1993).

Martin et al., "Standardization of Immunoglobulin M Capture Enzyme-Linked Immunosorbent Assays for Routine Diagnosis of Arboviral Infections." *J. Clin. Microbiol.* 38(5): 1823-1826 (May 2000).

Mason et al., "Sequence of the Dengue-1 Virus Genome in the Region Encoding the Three Structural Proteins and the Major Nonstructural Protein NS1." *Virology* 161:262-267 (1987).

Mason et al., "Japanese Encephalitis Virus-Vaccinia Recombinants Produce Particulate Forms of the Structural Membrane Proteins and Induce High Levels of Protection against Lethal JEV Infection." *Virology* 180:294-305 (1991).

Men et al., "Dengue Type 4 Virus Mutants Containing Deletions in the 3' Noncoding Region of the RNA Genome: Analysis of Growth Restriction in Cell Culture and Altered Viremia Pattern and Immunogenicity in Rhesus Monkeys." *J. Virol.* 70(6):3930-3937 (Jun. 1996).

Mir et al., "High-efficiency gene transfer into skeletal muscle mediated by electric pulses." *Proc. Nat. Acad. Sci.* USA 96:4262-4267 (Apr. 1999).

Monath et al., "Recombinant, chimeric live, attenuated vaccine (ChimeriVax) incorporating the envelope genes of Japanese encephalitis (SA14-14-2) virus and the capsid and nonstructural genes of yellow fever (17D) virus is safe, immunogenic and protective in non-human primates." *Vaccine* 17:1869-1882 (1999).

Nitayaphan et al., "Nucleotide Sequence of the Virulent SA-14 Strain of Japanese Encephalitis Virus and Its Attenuated Vaccine Derivative, SA-14-14-2." *Virology* 177:541-552 (1990).

Osatomi and Sumiyoshi, "Complete Nucleotide Sequence of Dengue Type 3 Virus Genome RNA." *Virology* 176:643-647 (1990).

Osatomi et al., "Nucleotide Sequence of Dengue Type 3 Virus Genomic RNA Encoding Viral Structural Proteins." *Virus Genes* 2(1):99-108 (1988).

Phillpotts et al., "Immunization with DNA polynucleotides protects mice against lethal challenge with St. Louis encephalitis virus." *Arch. Virol.* 141:743-749 (1996).

Pletnev, A. G. et al., "Chimeric Tick-Borne Encephalitis and Dengue Type 4 Viruses: Effects of Mutations on Neurovirulence in Mice." *J. Virol.* 67(8):4956-4963 (Aug. 1993).

Pletnev et al., "Construction and characterization of chimeric tick-borne encephalitis/ dengue type 4 viruses." *Proc. Natl. Acad. Sci. USA* 89:10532-10536 (Nov. 1992).

Puri et al., "Molecular analysis of dengue virus attenuation after serial passage in primary dog kidney cells." *J. Gen. Virol.* 78:2287-2291 (1997).

Rice et al., "Nucleotide Sequence of Yellow Fever Virus: Implications for Flavivirus Gene Expression and Evolution." *Science* 229:726-733 (1985).

Rice et al., "Transcription of Infectious Yellow Fever RNA from Full-Length cDNA Templates Produced by In Vitro Ligation." *New Biologist* 1(3):285-296 (Dec. 1989).

Roehrig et al., "Identification of Epitopes on the E Glycoprotein of Saint Louis Encephalitis Virus Using Monoclonal Antibodies." *Virology* 128:118-126 (1983).

Roehrig et al., "Synthetic Peptides Derived from the Deduced Amino Acid Sequence of the E-Glycoprotein of Murray Valley Encephalitis Virus Elicit Antiviral Antibody." *Virology* 171:49-60 (1989).

Sato et al., "Immunostimulatory DNA Sequences Necessary for Effective Intradermal Gene Immunization." *Science* 273(5273):352-354 (Jul. 19, 1996).

Seeger et al., "The cloned genome of ground squirrel hepatitis virus is infectious in the animal." *Proc. Natl. Acad. Sci. USA* 81:5849-5852 (Sep. 1984).

Sela. "The Choice of Carrier." *In Synthetic Vaccines* vol. I, R. Arnon, (ed) CRC Press Inc., Boca Raton, FL. Chapter 6 pp. 83-92 (1987).

Smithburn et al., "A Neurotropic Virus Isolated From The Blood Of A Native Of Uganda." *Am. J. Trop. Med. Hyg.* 20:471-492 (1940).

Subchareon et al., "Safety And Immunogenictiy Of Tetra Live-Attenuated Dengue Vaccines In Thai Adult Volunteers: Role Of Serotype Concentration, Ration, And Multiple Doses." *Am. J. Trop. Med. Hyg.* 66(3):264-272 (2002).

Sumiyoshi et al., "Complete Nucleotide Sequence of the Japanese Encephalitis Virus Genome RNA." *Virology* 161:497-510 (1987).

Tardei et al., "Evaluation of Immunoglobulin M (IgM) and IgG Enzyme Immunoassays in Serologic Diagnosis of West Nile Virus Infection." *J. Clin. Microbiol.* 38(6):2232-2239 (Jun. 2000).

Trent et al., "Partial Nucleotide Sequence of St. Louis Encephalitis Virus RNA: Structural Proteins, NS1, ns2a, and ns2b." *Virology* 156:293-304 (1987).

Trent et al., "Recombinant dengue virus vaccines." *In: Dengue and Dengue Hemorrhagic Fever*. D.J. Gubler and G. Kuno (eds.). CAB International, New York, NY Chapter 18 pp. 379-403 (1997).

Troyer et al., "A Live Attenated Recombinant Dengue-4 Virus Vaccine Candidate With Restricted capacity For Dissemination In Mosquitoes And Lack Of Transmission From Vaccinees To Mosquitoes." *Am. J. Trop. Med. Hyg.* 65(5):414-419 (2001).

Tsai et al., Japanese Encephalitis Vaccines. *In Vaccines*, (2nd edition), Plotkin and Mortimer (eds.), W.B. Saunders Co., Philadelphia, PA. Chapter 24, pp. 671-713 (1994).

Tsai et al., Japanese Encephalitis Vaccines. *In Vaccines*, (3rd edition) Plotkin and Orenstein (eds), W.B. Saunders Company, Philadelphia, PA. Chapter 27, pp. 672-710 (1999).

Update: "Surveillance for West Nile Virus in Overwintering Mosquitoes—New York, 2000." *Morb. Mortal. Wkly. Rep.* 49(09): 178-179 (Mar. 10, 2000).

Update: "West Nile Virus Activity—Northeastern United States, 2000." Morb. *Mortal. Wkly. Rep.* 49(36):820-822 (Sep. 15, 2000).

Vaughn et al., "Testing of dengue 2 live-attenuated vaccine (strain 16681 PDK 53) in ten American volunteers." *Vaccine* 14(4):329-336 (1996).

Venugopal et al., "Immunity to St. Louis encephalitis virus by sequential immunization with recombinant vaccinia and baculovirus derived PrM/E proteins." *Vaccine* 13(11):1000-1005 (1995).

Wang et al., "Immune Response to Neonatal Genetic Immunization." *Virology* 228:278-284 (1997).

Wolff et al., "Long-term persistence of plasmid DNA and foreign gene expression in mouse muscle." *Hum. Mol. Genet.* 1(6):363-369 (1992).

Yang et al., "A p300/CBP-associated factor that competes with the adenoviral oncoprotein E1A." *Nature* 382:319-324 (Jul. 25, 1996).

Yoksan et al., Dengue virus vaccine development: study on biological markers of uncloned dengue 1-4 viruses serially passaged in primary kidney cell, *In Arbovirus Research in Australia, Proceedings of the Fourth Symposium.* T. D. St. George, B. H. Kay, and J. Blok (eds.), CSIRO/QIMR, Brisbane p. 35-38 (1986).

Zhang et al., "Immunization of Mice with Dengue Structural Proteins and Nonstructural Protein NS1 Expressed by Baculovirus Recombinant Induces Resistance to Dengue Virus Encephalitis." *J. Virol.* 62(8): 3027-3031(Aug. 1988).

Zhang et al., "Passive Protection of Mice, Goats, and Monkeys Against Japanese Encephalitis With Monoclonal Antibodies." *J. Med. Virol.* 29:133-138 (1989).

Zhao et al., "Cloning Full-Length Dengue Type 4 Viral DNA Sequences: Analysis of Genes Coding for Structural Proteins." *Virology* 155:77-88 (1986).

Zhao et al., "Expression of Dengue Virus Structural Proteins and Nonstructural Protein NS1 by a Recombinant Vaccinia Virus." *J. Virol.* 61(12):4019-4022 (Dec. 1987).

* cited by examiner

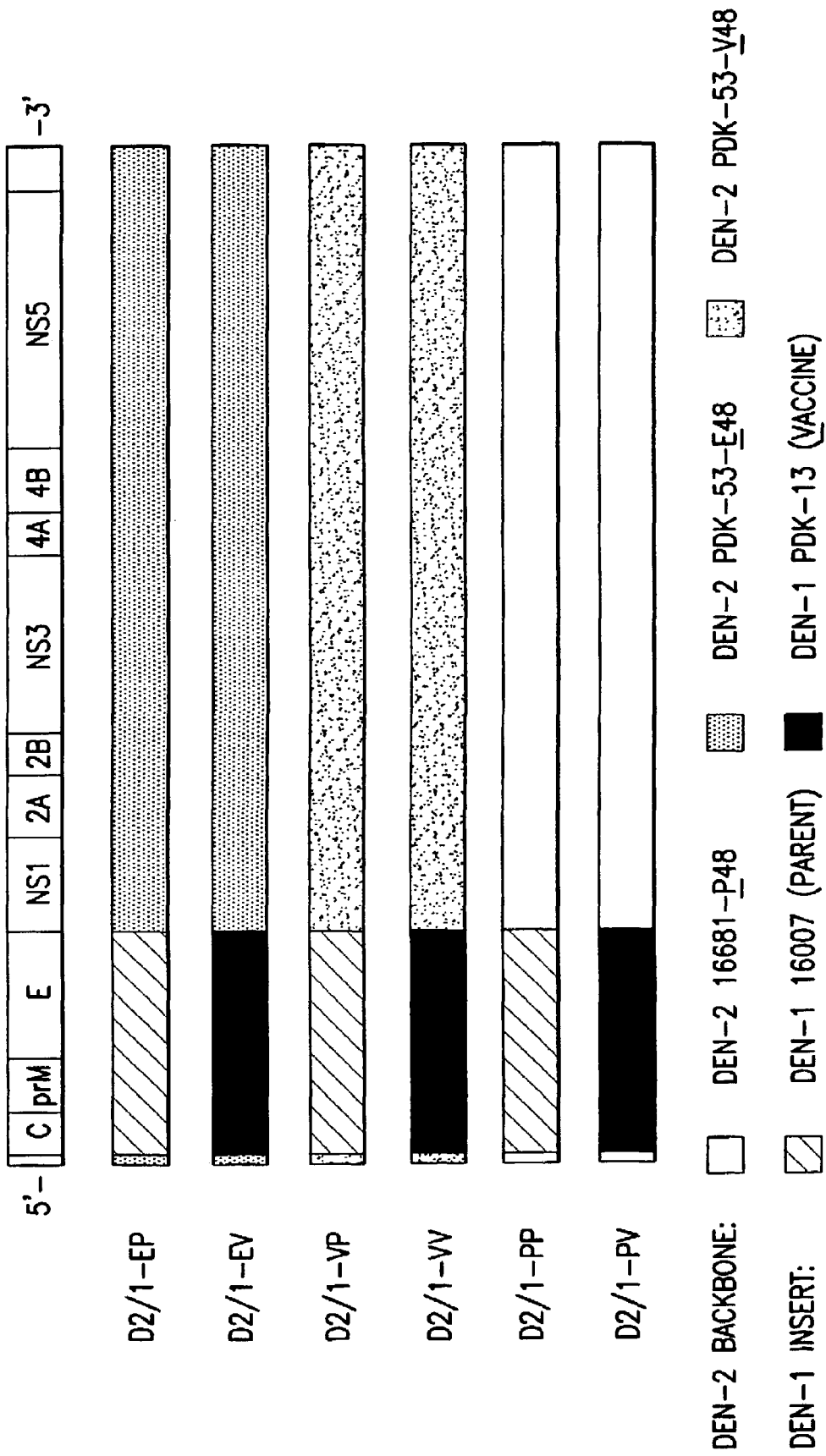

AVIRULENT, IMMUNOGENIC FLAVIVIRUS CHIMERAS

The present application is a 35 U.S.C. § 371 national phase application from, and claims priority to, international application PCT/US01/05142, filed Feb. 16, 2001 (published under PCT Article 21(2) in English), which claims priority to U.S. provisional patent application Ser. No. 60/182,829, filed Feb. 16, 2000, which applications are incorporated herein in their entirety by reference.

This invention was made by the Centers for Disease Control and Prevention, an agency of the United States Government. Therefore, the United States Government has certain rights in this invention.

FIELD OF THE INVENTION

The present invention relates to the fields of immunology and virology and more particularly to avirulent, immunogenic flavivirus chimeras for the production of immunogenic, live, attenuated flavivirus vaccines.

BACKGROUND OF THE INVENTION

Dengue viruses are mosquito-borne pathogens of the genus Flavivirus (family Flaviviridae). Four serotypes of dengue virus (often abbreviated "DEN") have been identified, including dengue-1, dengue-2, dengue-3 and dengue-4 (DEN-1 to DEN-4). The flavivirus genome is a single-stranded, positive-sense RNA approximately 11 kb in length, containing a 5'-noncoding region (5'NC); a coding region encoding the viral structural proteins; five nonstructural proteins, designated NS1, NS2A, NS2B, NS3, NS4A, NS4B, NS5; and a 3'-noncoding region (3'NC). The viral structural proteins include the capsid, premembrane/membrane and envelope. The structural and nonstructural proteins are translated as a single polyprotein. The polyprotein is then processed by cellular and viral proteases.

Transmitted by *Aedes aegypti* mosquitoes to humans in tropical and subtropical regions of the world, dengue viruses cause millions of cases of disease every year, ranging from dengue fever to the often fatal dengue hemorrhagic fever/dengue shock syndrome (DHF/DSS). Secondary infection of humans with a heterologous serotype of DEN virus may induce an immunopathological response and is considered a possible risk factor for DHF/DSS. Therefore, the need exists for development of a vaccine that confers simultaneous protection against all dengue virus strains.

Since eradication of *Aedes aegypti* mosquitoes appears to be practically infeasible, development of safe, effective vaccines against all four serotypes of dengue virus is a World Health Organization priority. However, no approved, effective vaccine against any of the dengue virus strains is currently available. It has been demonstrated that serial passage of wild-type flaviviruses in various cell cultures, such as primary dog kidney (PDK) cells, produces virus variants that have reduced virulence, retain immunogenicity and produce no untoward clinical symptoms.

Live, attenuated dengue viruses of all four serotypes have been developed at Mahidol University in Thailand by passaging the wild-type viruses in cell culture. These are currently the most promising live, attenuated vaccine candidates for immunization against dengue virus infection and/or disease. These vaccine candidates have been designated by a combination of their dengue serotype, the cell line through which they were passaged and the number of times they were passaged. Thus, a dengue serotype 1 wild-type virus passaged in PDK cells 13 times is designated as DEN-1 PDK-13 virus(nucleotide sequence, SEQ ID NO:3; amino acid sequence, SEQ ID NO:4). The other vaccine candidates are DEN-2 PDK-53 (nucleotide sequence, SEQ ID NO:15; amino acid sequence, SEQ ID NO:16), DEN-3 PGMK-30/FRhL-3 (thirty passages in primary green monkey kidney cells, followed by three passages in fetal rhesus lung cells)(nucleotide sequence, SEQ ID NO:21; amino acid sequence, SEQ ID NO:22) and DEN-4 PDK-48 (nucleotide sequence, SEQ ID NO:25; amino acid sequence, SEQ ID NO:26). These four candidate vaccine viruses were derived by tissue culture passage of wild-type parental DEN-1 16007 (nucleotide sequence, SEQ ID NO:1; amino acid sequence, SEQ ID NO:2), DEN-2 16681(nucleotide sequence, SEQ ID NO:13; amino acid sequence, SEQ ID NO:14), DEN-3 16562 (nucleotide sequence, SEQ ID NO:19; amino acid sequence, SEQ ID NO:20) and DEN-4 1036 (nucleotide sequence, SEQ ID NO:23; amino acid sequence, SEQ ID NO:24) viruses, respectively.

Preliminary human clinical trials with these attenuated viruses have indicated that DEN-2 PDK-53 has the lowest infectious dose (50% minimal infectious dose of 5 plaque forming units or PFU) in humans, is strongly immunogenic, and produces no unacceptable clinical symptoms. The DEN-1 PDK-13, DEN-3 PGMK-30/FRhL-3 and DEN-4 PDK-48 vaccine virus candidates have higher 50% minimal infectious doses of 10,000, 3500, and 150 PFU, respectively, in humans. The higher infectious doses required for the latter three vaccine candidates raises concerns regarding the relative efficacy of each serotype component in a tetravalent dengue virus vaccine. Although only one immunization with monovalent DEN-2 PDK-53 virus or DEN-4 PDK-48 virus was required to achieve 100% seroconversion in human subjects, a booster was needed to achieve the same seroconversion rate for DEN-1 PDK-13 and DEN-3 PGMK-30/FRhL-3 viruses, which have the two highest infectious doses for humans.

The DEN-2 PDK-53 virus vaccine candidate, henceforth abbreviated PDK-53, has several measurable biological markers associated with attenuation, including temperature sensitivity, small plaque size, decreased replication in mosquito C6/36 cell culture, decreased replication in intact mosquitoes, loss of neurovirulence for suckling mice and decreased incidence of viremia in monkeys. Clinical trials of the candidate PDK-53 vaccine have demonstrated its safety and immunogenicity in humans. Furthermore, the PDK-53 vaccine induces dengue virus-specific T-cell memory responses in human vaccine recipients.

Except for DEN-2 PDK-53 virus, the number and identity of the genetic mutations that accrued during multiple passages in cell culture and that are associated with the attenuated phenotypes of the vaccine candidates are unknown. Neither the relative contributions of such attenuation-associated mutations to the actual mechanism of attenuation, nor the potential for reverse mutations to revert any of the vaccine candidates to the virulent biological phenotype of the wild-type dengue virus are known for any of these four vaccine candidates. An understanding of the attenuation markers of a vaccine candidate is critical for the prediction of its stability and safety.

Accordingly, there is a need for avirulent, yet immunogenic, dengue viruses to be used in the development of dengue virus vaccines to confer protection against one or more dengue virus serotypes. What would be ideal is a vaccine that would simultaneously protect an individual against several virulent strains of this potentially dangerous family (Flaviviridae) of viruses. Therefore, a tetravalent vaccine that can be used to immunize an individual against all four dengue serotypes is particularly needed.

SUMMARY OF THE INVENTION

Immunogenic flavivirus chimeras, a dengue-2 virus backbone for preparing the flavivirus chimeras and methods for producing the flavivirus chimeras are described. The immunogenic flavivirus chimeras are provided, alone or in combination, in a pharmaceutically acceptable carrier as immunogenic compositions to minimize, inhibit, or immunize individuals against infection by one or more flaviviruses or flaviviral strains, particularly strains of the dengue virus serotypes DEN-1, DEN-2, DEN-3 and DEN-4. When combined, the immunogenic flavivirus chimeras may be used as multivalent vaccines to confer simultaneous protection against infection by more than one species or strain of flavivirus. Preferably, the flavivirus chimeras are combined in an immunogenic composition useful as a tetravalent vaccine against the four known dengue virus serotypes. The nucleic acid sequence for each of the DEN-1, DEN-3 and DEN-4 viruses is also provided, for use as probes to detect dengue virus in a biological sample.

The avirulent, immunogenic flavivirus chimeras provided herein contain the nonstructural protein genes of the attenuated dengue-2 virus, or the equivalent thereof, and one or more of the structural protein genes or immunogenic portions thereof of the flavivirus against which immunogenicity is to be conferred. For example, the preferred chimera contains the attenuated dengue-2 virus PDK-53 genome as the viral backbone, and the structural protein genes encoding capsid, premembrane/membrane, or envelope of the PDK-53 genome, or combinations thereof, are replaced with the corresponding structural protein genes from a flavivirus to be protected against, such as a different flavivirus or a different dengue virus serotype. The resulting viral chimera has the functional properties of the attenuated dengue-2 virus and is therefore avirulent, but expresses antigenic epitopes of the structural gene products and is therefore immunogenic.

In another embodiment, the preferred chimera is a nucleic acid chimera comprising a first nucleotide sequence encoding nonstructural proteins from an attentuated dengue-2 virus, and a second nucleotide sequence encoding a structural protein from a second flavivirus. In a further preferred embodiment, the attenuated dengue-2 virus is vaccine strain PDK-53. In a further preferred embodiment, the structural protein can be the C, prM or E protein of a flavivirus. Examples of flaviviruses from which the structural protein may be selected include, but are not limited to, dengue-1 virus, dengue-2 virus, dengue-3 virus, dengue-4 virus, West Nile virus, Japanese encephalitis virus, St. Louis encephalitis virus, yellow fever virus and tick-borne encephalitis virus. In a further embodiment, the structural protein may be selected from non-flavivirus species that are closely related to the flaviviruses, such as hepatitis C virus.

In evaluating the chimeric virus of the invention, it was unexpectedly discovered that the avirulence of the attenuated PDK-53 virus strain is attributable to the presence of specific amino acid substitution mutations in the nonstructural proteins and a nucleotide substitution mutation in the 5' noncoding region. This nucleotide substitution mutation occurs in the stem of a stem-loop structure that is conserved in all four dengue serotypes. In particular, a single mutation at NS1-53, a double mutation at NS1-53 and at 5'NC-57, a double mutation at NS1-53 and at NS3-250, and a triple mutation at NS1-53, at 5'NC-57 and at NS3-250, can provide the attenuated DEN-2 virus of the present invention.

Furthermore, the genome of any dengue-2 virus containing non-conservative amino acid substitutions at these loci can be used as the backbone in the avirulent chimeras described herein. Furthermore, other flavivirus genomes containing analogous mutations at the same loci, after amino acid sequence or nucleotide sequence alignment and stem structure analysis can also be used as the backbone structure and are defined herein as being equivalent to attenuating mutations of the dengue-2 PDK-53 genome.

The backbone, that region of the chimera that comprises the 5' and 3' noncoding regions and the region encoding the nonstructural proteins, can also contain further mutations to maintain stability of the avirulent phenotype and to reduce the possibility that the avirulent virus or chimera might revert back to the virulent wild-type virus. For example, a second mutation in the stem of the stem/loop structure in the 5' noncoding region will provide additional stability, if desired.

These chimeric viruses can comprise nucleotide and amino acid substitutions, deletions or insertions in their structural and nonstructural proteins in addition to those specifically described herein.

The structural and nonstructural proteins of the invention are to be understood to include any protein comprising or any gene encoding the sequence of the complete protein, an epitope of the protein, or any fragment comprising, for example, two or more amino acid residues thereof.

The present invention also provides a method for making the chimeric viruses of this invention using recombinant techniques, by inserting the required substitutions into the appropriate backbone genome.

The present invention also provides compositions comprising a pharmaceutically acceptable carrier and attenuated chimeric viruses of this invention which contain amino acid sequences derived from other dengue virus serotypes, other flavivirus species or other closely related species, such as hepatitis C virus. As an object of the invention, the amino acid sequences derived from other dengue virus serotypes, other flavivirus species or other closely related species, such as hepatitis C virus, are expressed in a host, host cell or cell culture. As a further object of the invention, proteins or polypeptides comprising the amino acid sequences derived from other dengue virus serotypes, other flavivirus species or other closely-related species, can act as immunogens and, thus, be used to induce an immunogenic response against other dengue virus serotypes, other flavivirus species or other closely related species.

The present invention also provides compositions comprising a pharmaceutically acceptable carrier, one or more attenuated chimeric viruses of this invention and further immunizing compositions. Examples of such further immunizing compositions include, but are not be limited to, dengue virus vaccines, yellow fever virus vaccines, tick-borne encephalitis virus vaccines, Japanese encephalitis virus vaccines, West Nile virus vaccines, hepatitis C virus vaccines or other virus vaccines. Such vaccines may be live attenuated virus vaccines, killed virus vaccines, subunit vaccines, recombinant DNA vector vaccines or any combination thereof.

A distinct advantage of the current invention is that it provides for mixtures of attenuated flavivirus chimeras to be used as vaccines in order to impart immunity against several flavivirus species simultaneously.

Thus, an object of the current invention is to provide a virus chimera containing amino acid or nucleotide substitutions which retain immunogenicity of the virus while preventing any pathogenic effects of the virus.

Another object of the present invention is to provide nucleic acid chimeras comprising nucleotide sequence from an attenuated dengue-2 virus and nucleotide sequence from a second flavivirus, wherein the nucleotide sequence from the second flavivirus directs the synthesis of flavivirus antigens.

Another object of the present invention is to provide compositions for vaccines comprising more than one flavivirus species.

Another object of the present invention is to provide a method for making immunogenic or vaccine compositions using recombinant techniques by inserting the required substitutions into an appropriate flavivirus genome.

Another object of the invention is to provide compositions and methods for imparting immunity against more than one flavivirus simultaneously.

Another object of the invention is to provide nucleic acid probes and primers for use in any of a number of rapid genetic tests that are diagnostic for each of the vaccine viruses of the current invention. This object of the invention may be embodied in polymerase chain reaction assays, hybridization assays or other nucleic acid sequence detection techniques known to the art. A particular embodiment of this object is an automated PCR-based nucleic acid detection system.

These and other objects, features and advantages of the present invention will become apparent after review of the following detailed description of the disclosed embodiments and the appended claims.

BRIEF DESCRIPTION OF THE FIGURES

FIG. 1 schematically shows the genomic organization of the chimeric DEN-2/DEN-1 viruses. Designations of the chimeras are based on the DEN-2 virus-specific infectious clone backbones and the structural genes (C-prM-E) insert of DEN-1 viruses. Underlined letters of the backbone and insert viruses are used in the designations. D2/1 indicates DEN-2/DEN-1 chimera; the first letter following the hyphen is the DEN-2 viral backbone, parent 16681 (P), PDK53-E (E), or PDK53-V (V); the last letter indicates the structural genes from the parental DEN-1 16007 (P) strain or its vaccine derivative, strain PDK-13 (V). The PDK53-E backbone contains three DEN-2 PDK-53 virus-specific amino acid mutations (NS1-53-Asp, NS2A-181-Phe, and NS4A-75-Ala) as well as the 5'NC-57 mutation of PDK-53 virus. The PDK53-V backbone contains these same PDK-53 virus-specific loci plus the additional PDK-53 virus-specific NS3-250-Val locus.

FIG. 2A: Mean (±SD) plaque diameters. Values were calculated from ten individual plaques of each virus on day 10 after infection. pp: pinpoint-size plaques less than 1 mm. FIG. 2B: Temperature sensitivity (ts) and peak titers of chimeric viruses on day 8 or 10 after infection. The ts scores were based on the reduction of the virus titers at 38.7° C. versus those at 37° C. (−, +, 2+ and 3+ indicate titer reduction of less than or equal to 60%, 61–90%, 91–99%, >99%, respectively, calculated from at least three experiments). The graph bar heights represent the $\log_{10}$ titers of the viruses at 37° C. The multiplicity of infection (m.o.i.) was approximately 0.001 PFU/cell.

FIG. 4A: Mean plaque diameters±SD in millimeters (n=12) of DEN-2 16681, PDK-53 and recombinant 16681/PDK-53 viruses at nine days after infection in LLC-MK$_2$ cells. FIG. 4B: Peak replication titers at 6–8 days after infection of LLC-MK$_2$ cells at a m.o.i. of approximately 0.001 PFU/cell in a single experiment. Temperature sensitivity (ts) scores for viruses grown at 37° C. or 38.7° C. in LLC-MK$_2$ cells are shown above the graph bars for peak replication titers. Scores of (−), (+/−) and (+) indicate less than 81%, 81–89% and 90–97% reduction in viral titer, respectively, at 38.7° C. Scores were determined at eight days after infection. FIG. 4C: Average peak replication titers at 12 days after infection of C6/36 cells at a multiplicity of approximately 0.001 PFU/cell in two independent experiments. Individual peak titers from the two experiments are indicated by vertical lines in each graph bar. The numerical designations for recombinant Px and Vx viruses (where x=5'NC, NS1, and/or NS3 loci) indicate parental (P in virus designation) 16681 virus-specific loci engineered into the PDK-53 virus-specific infectious cDNA clone or reciprocal candidate PDK-53 vaccine (V in virus designation) virus-specific loci engineered into the 16681 clone, respectively. Cognate viruses are indicated in all three graphs by graph bars of identical solid or cross-hatching pattern. The cognate for P5 virus is V13 virus, assuming that the viral phenotype is determined predominantly by the 5'NC-57, NS1-53 and NS3-250 loci. Both P5 and V13 viruses contain the 5'NC-57-C (16681), NS1-53-Asp (PDK-53) and NS3-250-Val (PDK-53) loci within the genetic backgrounds of PDK-53 and 16681 viruses, respectively.

DETAILED DESCRIPTION OF THE INVENTION

Figure 2A:
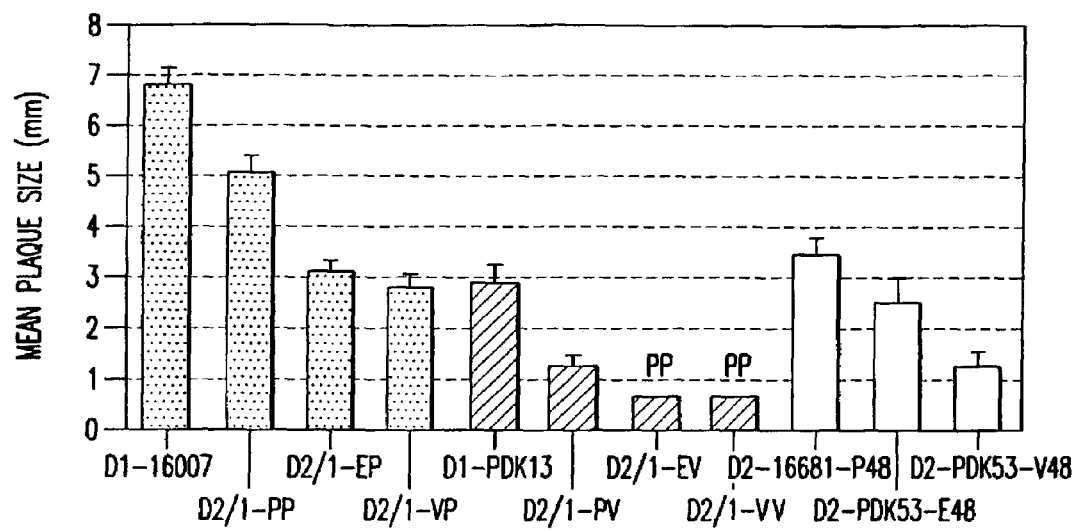
FIGS. 2A and 2B show the growth characteristics of the chimeric DEN-2/DEN-1 viruses in LLC-MK$_2$ cells. Stippled bars indicate DEN-1 16007 virus and the chimeric viruses expressing the structural proteins of DEN-1 16007 virus. Bars with stripes indicate DEN-1 PDK-13 virus and the chimeric viruses expressing structural proteins of PDK-13 virus. Blank bars indicate the three DEN-2 backbone viruses derived from infectious clones of DEN-2 16681 virus (P48) and the two variants (PDK53-E and PDK53-V; E48 and V48, respectively).
Figure 2B:
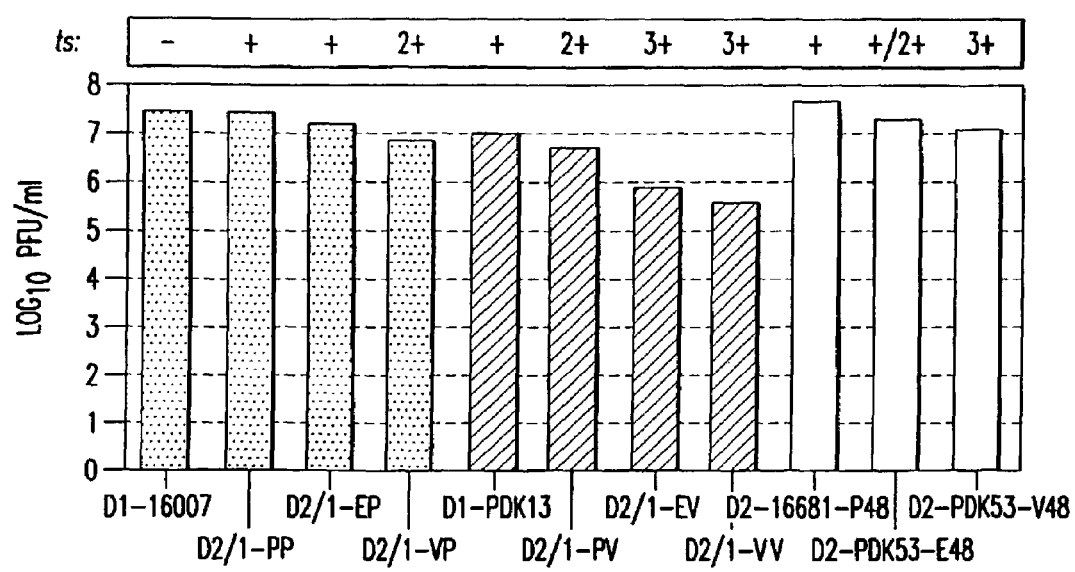

The following description includes the best presently contemplated mode of carrying out the invention. This description is made for the purpose of illustrating the general principles of the inventions and should not be taken in a limiting sense.

Immunogenic flavivirus chimeras, a dengue-2 virus or dengue-2 virus equivalent backbone for preparing the flavivirus chimeras of this invention and methods for preparing the flavivirus chimeras are provided herein. The immunogenic flavivirus chimeras are useful, alone or in combination, in a pharmaceutically acceptable carrier as immunogenic compositions to minimize, inhibit, or immunize individuals against infection by one or more flaviviruses or flaviviral strains, particularly strains of the dengue virus serotypes DEN-1, DEN-2, DEN-3 and DEN-4. When combined, the immunogenic flavivirus chimeras may be used as a multivalent vaccine to confer simultaneous protection against infection. Preferably, the dengue virus chimeras are combined in an immunogenic composition useful as a tetravalent vaccine against the four known dengue virus serotypes.

Immunogenic flavivirus chimeras of the current invention are also useful, in combination with avirulent virus strains, in a pharmaceutically acceptable carrier, as immunogenic compositions to minimize, inhibit or immunize individuals against infection by multiple pathogenic species. For example, one or more of the immunogenic flavivirus chimeras of the current invention can be combined with avirulent virus serotypes of selected flaviviruses to provide a safe and effective tetravalent vaccine against the four known dengue virus serotypes. In a further embodiment, the flavivirus chimeras of the current invention may be combined with avirulent virus vaccines to provide a safe and effective vaccine against infection by multiple pathogenic species.

The present invention also provides compositions comprising a pharmaceutically acceptable carrier, one or more attenuated chimeric viruses of this invention and further immunizing compositions. Examples of such further immunizing compositions include, but are not be limited to, dengue virus vaccines, yellow fever vaccines, tick-borne encephalitis vaccines, Japanese encephalitis vaccines, West Nile virus vaccines, hepatitis C virus vaccines or other virus vaccines. Such vaccines may be live attenuated virus vaccines, killed virus vaccines, subunit vaccines, recombinant DNA vector vaccines or any combination thereof.

The nucleic acid sequence for each of the DEN-1, DEN-3 and DEN-4 viruses is also provided for use as probes to detect dengue virus in a biological sample.

Chimeras of the present invention can comprise the backbone of the dengue-2 virus of an attenuated dengue-2 virus and further nucleotide sequences selected from more than one dengue virus serotype, other flavivirus species, other closely related species, such as hepatitis C virus, or any combination thereof. These chimeras can be used to induce an immunogenic response against more than one species selected from the dengue virus serotypes, flavivirus species, other closely related species or any combination thereof.

In another embodiment, the preferred chimera is a nucleic acid chimera comprising a first nucleotide sequence encoding nonstructural proteins from an attentuated dengue-2 virus, and a second nucleotide sequence encoding a structural protein from a second flavivirus. In a further preferred embodiment, the attenuated dengue-2 virus is vaccine strain PDK-53. In a further preferred embodiment, the structural protein can be the C protein of a flavivirus, the prM protein of a flavivirus, the E protein of a flavivirus, or any combination thereof. Examples of flaviviruses from which the structural protein may be selected include, but are not limited to, dengue-1 virus, dengue-2 virus, dengue-3 virus, dengue-4 virus, West Nile virus, Japanese encephalitis virus, St. Louis encephalitis virus, yellow fever virus and tick-borne encephalitis virus. In a further embodiment, the structural protein may be selected from non-flavivirus species that are closely related to the flaviviruses, such as hepatitis C virus.

The terms "a," "an" and "the" as used herein are defined to mean one or more and include the plural unless the context is inappropriate.

The term "residue" is used herein to refer to an amino acid (D or L) or an amino acid mimetic that is incorporated into a peptide by an amide bond. As such, the amino acid may be a naturally occurring amino acid or, unless otherwise limited, may encompass known analogs of natural amino acids that function in a manner similar to the naturally occurring amino acids (i.e., amino acid mimetics). Moreover, an amide bond mimetic includes peptide backbone modifications well known to those skilled in the art.

Furthermore, one of skill in the art will recognize that individual substitutions, deletions or additions in the amino acid sequence, or in the nucleotide sequence encoding for the amino acids, which alter, add or delete a single amino acid or a small percentage of amino acids (typically less than 5%, more typically less than 1%) in an encoded sequence are conservatively modified variations, wherein the alterations result in the substitution of an amino acid with a chemically similar amino acid. Conservative substitution tables providing functionally similar amino acids are well known in the art. The following six groups each contain amino acids that are conservative substitutions for one another:
1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

As used herein, the terms "virus chimera," "chimeric virus," "flavivirus chimera" and "chimeric flavivirus" means an infectious construct of the invention comprising a portion of the nucleotide sequence of a dengue-2 virus and further nucleotide sequence that is not from the same dengue-2 virus. Thus, examples of further nucleotide sequence include, but are not limited to, sequences from dengue-1 virus, dengue-2 virus, dengue-3 virus, dengue-4 virus, West Nile virus, Japanese encephalitis virus, St. Louis encephalitis virus, tick-borne encephalitis virus, yellow fever virus and any combination thereof.

As used herein, "infectious construct" indicates a virus, a viral construct, a viral chimera, a nucleic acid derived from a virus or any portion thereof, which may be used to infect a cell.

As used herein, "nucleic acid chimera" means a construct of the invention comprising nucleic acid comprising a portion of the nucleotide sequence of a dengue-2 virus and further nucleotide sequence that is not of the same origin as the nucleotide sequence of the dengue-2 virus. Correspondingly, any chimeric flavivirus or flavivirus chimera of the invention is to be recognized as an example of a nucleic acid chimera.

The structural and nonstructural proteins of the invention are to be understood to include any protein comprising or any gene encoding the sequence of the complete protein, an epitope of the protein, or any fragment comprising, for example, two or more amino acid residues thereof.

Nucleotide sequences of the RNA genome of the viruses and chimeras of the current invention are recited in the sequence listings in terms of DNA.

Unless defined otherwise, all technical and scientific terms used herein have the same meaning as commonly understood by one having ordinary skill in the art to which this invention pertains. Although other materials and methods similar or equivalent to those described herein can be used in the practice or testing of the present invention, the preferred methods and materials are now described.

Flavivirus Chimeras

Dengue virus types 1–4 (DEN-1 to DEN-4) are mosquito-borne flavivirus pathogens. The flavivirus genome contains a 5'-noncoding region (5'-NC), followed by a capsid protein (C) encoding region, followed by a premembrane/membrane protein (prM) encoding region, followed by an envelope protein (E) encoding region, followed by the region encoding the nonstructural proteins (NS1-NS2A-NS2B-NS3-NS4A-NS4B-NS5) and finally a 3' noncoding region (3'NC). The viral structural proteins are C, prM and E, and the nonstructural proteins are NS1–NS5. The structural and nonstructural proteins are translated as a single polyprotein and processed by cellular and viral proteases.

The flavivirus chimeras of the invention are constructs formed by fusing non-structural protein genes from one type, or serotype, of dengue virus or virus species of the flaviviridae, with protein genes, for example, structural protein genes, from a different type, or serotype, of dengue virus or virus species of the flaviviridae. Alternatively, a flavivirus chimera of the invention is a construct formed by fusing non-structural protein genes from one type, or serotype, of dengue virus or virus species of the flaviviridae, with further nucleotide sequences that direct the synthesis of polypeptides or proteins selected from other dengue virus serotypes or other viruses of the flaviviridae.

The avirulent, immunogenic flavivirus chimeras provided herein contain the nonstructural protein genes of the attenuated dengue-2 virus, or the equivalent thereof, and one or more of the structural protein genes, or antigenic portions thereof, of the flavivirus against which immunogenicity is to be conferred. Suitable flaviviruses include, but are not limited to those listed in Table 1.

Other suitable flaviviruses for use in constructing the flavivirus chimeras of the invention are wild-type, virulent DEN-1 16007 (SEQ ID NO:1; SEQ ID NO:2), DEN-2 16681 (SEQ ID NO:13; SEQ ID NO:14), DEN-3 16562 (SEQ ID NO:19; SEQ ID NO:20) and DEN-4 1036 (SEQ ID NO:23; SEQ ID NO:24) and attenuated, vaccine-strain DEN-1 PDK-13 (SEQ ID NO:3; SEQ ID NO:4), DEN-2 PDK-53 (SEQ ID NO:15; SEQ ID NO:16), DEN-3 PMK-30/FRhL-3 (SEQ ID NO:21; SEQ ID NO:22) and DEN-4 PDK-48 (SEQ ID NO:25; SEQ ID NO:26). Further suitable flaviviruses, or variants of the above listed flaviviruses, are described herein. Genetic differences between the DEN-1, DEN-2, DEN-3 and DEN-4 wild type/attenuated virus pairs are shown in Tables 2–5 along with changes in the amino acid sequences encoded by the viral genomes.

The sequence listings for DEN-2 PDK-53 provided herein (SEQ ID NO:15; SEQ ID NO:16) correspond to the DEN-2 PDK-53-V variant, wherein genome nucleotide position 5270 is mutated from an A to a T and amino acid position 1725 of the polyprotein or amino acid position 250 of the NS3 protein contains a valine residue. The DEN-2 PDK-53 variant without this nucleotide mutation, DEN-2 PDK-53-E, differs from PDK-53-V only in this one position. DEN-2 PDK-53-E has an A at nucleotide position 5270 and a glutamate at polyprotein amino acid position 1725, NS3 protein amino acid position 250 (Table 3).

The sequence listings for DEN-3 16562 provided herein (SEQ ID NO:21; SEQ ID NO:22) correspond to the variant wherein genome nucleotide position 1521 is a T and amino acid position 476 of the polyprotein or amino acid position 196 of the E protein contain a leucine. A second variant, present in DEN-3 16562 cultures has a T at nucleotide position 1521 and amino acid position 476 of the polyprotein or amino acid position 196 of the E protein contain a serine (Table 4).

The sequence listings for DEN-4 PDK-48 (SEQ ID NO:25; SEQ ID NO:26) correspond to the variant wherein genome nucleotide positions: 6957 is a T and amino acid position 2286 of the polyprotein and amino acid position 44 of NS4B protein is a phenylalanine, 7546 is a T and amino acid position 2366 of the polyprotein and amino acid position 240 of NS4B protein is a valine, and 7623 is a T and amino acid position 2508 of the polyprotein and amino acid position 21 of NS5 protein is a tyrosine (Table 5).

Throughout the text, designations of the chimeras are based on the DEN-2 virus-specific infectious clone backbones and the structural genes (prM-E or C-prM-E) insert of other flaviviruses. Each designation begins with DEN-2 for the dengue-2 backbone, followed by the strain from which the structural genes are inserted. The particular backbone variant is reflected in the next letter. The particular DEN-2 backbone variant from which the chimera was constructed is indicated by the following letter placed after a hyphen, parent 16681 (P), PDK53-E (E), or PDK53-V (V); the last letter indicates the C-prM-E structural genes from the parental (P) strain or its vaccine derivative (V) or the prM-E structural genes from the parental (P1) or its vaccine derivative (V1). For example; DEN-2/1-VP (SEQ ID NO:5; SEQ ID NO:6) denotes the chimera comprising the attenuated DEN-2 PDK-53V backbone comprising a valine at NS3-250 and the C-prM-E genes from wild-type DEN-1 16007; DEN-2/1-VV (SEQ ID NO:7; SEQ ID NO:8) denotes the DEN-2 PDK-53V backbone with the vaccine strain of dengue-1, DEN-1 PDK-13; DEN-2/1-VP1 (SEQ ID NO:27; SEQ ID NO:28) denotes the DEN-2 PDK-53V backbone and the prM-E genes from wild-type DEN-1 16007; DEN-2/3-VP1 (SEQ ID NO:9; SEQ ID NO:10) denotes the DEN-2 PDK-53V backbone and the prM-E genes from wild-type DEN-3 16562; DEN-2/4-VP1 (SEQ ID NO:11; SEQ ID NO:12) denotes the DEN-2 PDK-53V backbone and the prM-E genes from wild-type DEN-4 1036; and DEN-2/WN-PP1 (SEQ ID NO:17; SEQ ID NO:18) denotes the DEN-2 16681 backbone and the prM-E genes from West Nile NY99. Other chimeras of the present invention, denoted in the same manner, are clearly defined herein by the disclosed sequences. For instance, DEN-2/1-PV is defined herein as consisting of the wild-type dengue-2 backbone, DEN-2 16681, and the C-prM-E genes of the vaccine strain of dengue-1, DEN-1 PDK-13.

The preferred chimera of the invention, for example, contains the attenuated dengue-2 virus PDK-53 genome as the viral backbone, in which the structural protein genes encoding C, prM and E proteins of the PDK-53 genome, or combinations thereof, are replaced with the corresponding structural protein genes from a flavivirus to be protected against, such as a different flavivirus or a different dengue virus strain. Newly discovered flaviviruses or flavivirus pathogens can also be incorporated into the DEN-2 backbone. Genetic recombinations with related viruses such as hepatitis C virus (HCV) could also be used to produce the chimeras of this invention. The resulting viral chimera has the functional properties of the attenuated dengue-2 virus and is therefore avirulent, but expresses antigenic epitopes of the structural gene products and is therefore immunogenic.

Nine nucleotide mutations between the genomes of the wild type DEN-2 16681 virus and two attenuated PDK-53 virus strains are identified herein (Table 3). Three of these mutations are silent mutations in that they do not result in the production of an amino acid that differs from the amino acid in the same position in the wild type virus. The first mutation is a C-to-T (wild type-to-PDK-53) nucleotide mutation at genome nucleotide position 57 (nt 57) in the 5' noncoding region. The second mutation is a A-to-T mutation at genome nucleotide position 524, encoding the amino acid substitution Asp-to-Val in the structural protein premembrane region, prM-29.

In the nonstructural protein regions, a Gly-to-Asp (wild type-to-PDK-53) mutation was discovered at nonstructural protein NS1-53 (genome nucleotide position 2579); a Leu-to-Phe (wild type-to-PDK-53) mutation was discovered at nonstructural protein NS2A-181 (genome nucleotide position 4018); a Glu-to-Val (wild type-to-PDK-53) mutation was discovered at nonstructural protein NS3-250 (genome nucleotide position 5270); and a Gly-to-Ala mutation (wild type-to-PDK-53) was discovered at nonstructural protein NS4A-75 (genome nucleotide position 6599).

The attenuated PDK-53 virus strain has a mixed genotype at genome nt 5270. A significant portion (approximately 29%) of the virus population encodes the non-mutated NS3-250-Glu that is present in the wild type DEN-2 16681 virus rather than the NS3-250-Val mutation. As both genetic variants are avirulent, this mutation may not be necessary in an avirulent chimera.

It was unexpectedly discovered that the avirulence of the attenuated PDK-53 virus strain can be attributed to the presence of specific mutations in the nucleotide sequence encoding nonstructural proteins and in the 5' noncoding region (Example 5). In particular, a single mutation at NS1-53, a double mutation at NS1-53 and at 5'NC-57, a double mutation at NS1-53 and at NS3-250 and a triple mutation at NS1-53, at 5'NC-57 and at NS3-250, result in attenuation of the DEN-2 virus. Therefore, the genome of any dengue-2 virus containing such non-conservative amino acid substitutions or nucleotide substitutions at these loci can be used as the backbone in the avirulent chimeras described herein. The backbone can also contain further mutations to maintain stability of the avirulent phenotype and to reduce the possibility that the avirulent virus or chimera might revert back to the virulent wild-type virus. For example, a second mutation in the stem of the stem/loop structure in the 5' noncoding region will provide additional avirulent phenotype stability, if desired. The stem of the stem-loop structure is composed of nucleotide residues 11–16 (CUACGU) (SEQ ID NO:29) and nucleotide residues 56–61 (ACGUAG) (SEQ ID NO:30) of the dengue-2 virus RNA sense sequence, wherein the underlined nucleotide is C in wild-type DEN-2 16681 virus and U in PDK-53 virus. Mutations to this region disrupt potential secondary structures important for viral replication. In particular, mutations in the 5' noncoding region have the ability to disrupt the function of the positive-sense RNA strand and the function of the negative-sense strand during replication. A single mutation in this short (only 6 nucleotide residues in length) stem structure in both DEN and Venezuelan equine encephalitis viruses disrupts the formation of the hairpin structure (Kinney et al., *Virology* 67, 1269–1277, (1993)). Further mutations in this stem structure decrease the possibility of reversion at this locus, while maintaining virus viability. Furthermore, flavivirus genomes containing an analogous stem structure that consists of short nucleotide sequences (stems consisting of 6 or more base pairs in the stem-loop structure) located in the 5' noncoding region and having one or more mutations in the stem structure may also be useful as the backbone structure of this invention.

Such mutations may be achieved by site-directed mutagenesis using techniques known to those skilled in the art. Furthermore, other flavivirus genomes containing analogous mutations at the same loci after amino acid sequence alignment, can be used as the backbone structure of the chimera of this invention and are defined herein as being equivalent to the dengue-2 PDK-53 genome. It will be understood by those skilled in the art that the virulence screening assays, as described herein and as are well known in the art, can be used to distinguish between virulent and avirulent backbone structures.

Construction of Flavivirus Chimeras

The flavivirus chimeras described herein can be produced by splicing one or more of the structural protein genes of the flavivirus against which immunity is desired into a PDK-53 dengue virus genome backbone, or the equivalent thereof as described above, using recombinant engineering techniques well known to those skilled in the art to remove the corresponding PDK-53 gene and replace it with the desired gene. Alternatively, using the sequences provided in the sequence listing, the nucleic acid molecules encoding the flavivirus proteins may be synthesized using known nucleic acid synthesis techniques and inserted into an appropriate vector. Avirulent, immunogenic virus is therefore produced using recombinant engineering techniques known to those skilled in the art.

As mentioned above, the gene to be inserted into the backbone encodes a flavivirus structural protein. Preferably the flavivirus gene to be inserted is a gene encoding a C protein, a PrM protein and/or an E protein. The sequence inserted into the dengue-2 backbone can encode both the PrM and E structural proteins. The sequence inserted into the dengue-2 backbone can encode the C, prM and E structural proteins. The dengue virus backbone is the PDK-53 dengue-2 virus genome and includes either the spliced genes that encode the C, PrM and/or E structural proteins of dengue-1 (DEN-2/1), the spliced genes that encode the PrM and/or E structural proteins of dengue-3 (DEN-2/3), or the spliced genes encode the PrM and/or E structural proteins of dengue-4 (DEN-2/4). In a particular embodiment of this invention, the spliced gene that encodes the structural protein of dengue-3 virus directs the synthesis of an E protein that contains a leucine at amino acid position 345.

In a particular embodiment, the chimera of this invention encodes the C structural protein of dengue-2 virus and directs the synthesis of a C protein that contains a serine at amino acid position 100 and comprises a spliced gene encoding the structural proteins of dengue-4 which directs the synthesis of an E protein that contains a leucine at amino acid position 447.

In a further embodiment, the chimera of this invention encodes the C structural protein of dengue-2 virus and directs the synthesis of a C protein that contains a serine at amino acid position 100 and comprises a spliced gene encoding the structural proteins of dengue-4 which directs the synthesis of an E protein that contains a leucine at amino acid position 447 and a valine at amino acid position 364. The structural proteins described herein can be present as the only flavivirus structural protein or in any combination of flavivirus structural proteins in a viral chimera of this invention.

The chimeras of this invention are engineered by recombination of full genome-length cDNA clones derived from both DEN-2 16681 wild type virus and either of the PDK-53 dengue-2 virus variants (-E or -V(SEQ ID NO:15)). The uncloned PDK-53 vaccine contains a mixture of two genotypic variants, designated herein as PDK53-E and PDK53-V. The PDK53-V variant contains all nine PDK-53 vaccine-specific nucleotide mutations, including the Glu-to-Val mutation at amino acid position NS3-250. The PDK53-E variant contains eight of the nine mutations of the PDK-53 vaccine and the NS3-250-Glu of the parental 16681 virus. Infectious cDNA clones are constructed for both variants, and viruses derived from both clones are attenuated in mice. The phenotypic markers of attenuation of DEN-2 PDK-53 virus include small plaque size, temperature sensitivity (particularly in LLC-MK$_2$ cells), limited replication (particularly in C6/36 cells), attenuation for newborn mice (specifically loss of neurovirulence for suckling mice) and decreased incidence of viremia in monkeys. The chimeras that are useful as vaccine candidates are constructed in the genetic backgrounds of the two DEN-2 PDK-53 variants which all contain mutations in nonstructural regions of the genome, including 5'NC-57 C-to-T (16681-to-PDK-53) in the 5' noncoding region, as well as mutations in the amino acid sequence of the nonstructural proteins, such as, for example, NS1-53 Gly-to-Asp and NS3-250 Glu-to-Val.

Suitable chimeric viruses or nucleic acid chimeras containing nucleotide sequences encoding structural proteins of other flaviviruses or dengue virus serotypes can be evaluated for usefulness as vaccines by screening them for the foregoing phenotypic markers of attenuation that indicate avirulence and by screening them for immunogenicity. Antigenicity and immunogenicity can be evaluated using in vitro or in vivo reactivity with flavivirus antibodies or immunoreactive serum using routine screening procedures known to those skilled in the art.

Flavivirus Vaccines

The preferred chimeric viruses and nucleic acid chimeras provide live, attenuated viruses useful as immunogens or vaccines. In a preferred embodiment, the chimeras exhibit high immunogenicity while at the same time producing no dangerous pathogenic or lethal effects.

Until now, an effective vaccine against all strains of dengue virus has been unavailable. Individual live attenuated vaccine candidates for all four serotypes have been developed by serial passage of wild-type viruses in primary dog kidney (PDK) cells or other cell types. As described above, the PDK-53 virus is a useful dengue vaccine candidate. However, a vaccine derived from PDK-53 would only provide immunity against the DEN-2 serotype.

To prevent the possible occurrence of DHF/DSS in patients vaccinated against only one serotype of dengue virus, a tetravalent vaccine is needed to provide simultaneous immunity for all four serotypes of the virus. A tetravalent vaccine is produced by combining dengue-2 PDK-53 with the dengue-2/1, dengue-2/3, and dengue-2/4 chimeras described above in a suitable pharmaceutical carrier for administration as a multivalent vaccine.

The chimeric viruses or nucleic acid chimeras of this invention can comprise the structural genes of either wild-type or attenuated virus in a virulent or an attenuated DEN-2 virus backbone. For example, the chimera may express the structural protein genes of wild-type DEN-1 16007 virus or its candidate PDK-13 vaccine derivative in either of the DEN-2 PDK-53 backgrounds.

As described in Example 1, all of the chimeric DEN-2/1 viruses containing the C, prM and E proteins of either DEN-1 16007 virus (DEN-2/1-EP and -VP chimeras) or PDK-13 virus (DEN-2/1-EV and -VV (SEQ ID NO:7) chimeras) in the backbones of DEN-2 PDK-53 retain all of the phenotypic attenuation markers of the DEN-2 PDK-53 virus. The chimeric DEN-2/1-EP and -VP(SEQ ID NO:5) viruses, which contain the C, prM and E proteins of DEN-1 16007 virus are more genetically stable after passing in cell culture than the DEN-2/1-EV and -VV viruses. The immunogenicity of the chimeric viruses expressing the structural proteins of DEN-1 16007 virus was higher as compared with the neutralizing antibody titers elicited by the PDK-13 vaccine virus and the chimeras expressing the structural proteins of the PDK-13 virus. Thus, the chimeric DEN-2/1-EP and -VP viruses, which express the structural genes of wild-type DEN-1 16007 virus within the genetic background of the two DEN-2 PDK-53 variants, are potential DEN-1 vaccine candidates that are superior to the candidate PDK-13 vaccine.

These two chimeras replicate well in LLC-MK$_2$ cells and retain the attenuation markers associated with DEN-2 PDK-53 virus, including small plaque size, temperature sensitivity, restricted replication in mosquito cells and attenuation for mice. They are at least as immunogenic as wild-type DEN-1 16007 virus in mice.

Other examples, such as DEN-2/3 and DEN-2/4 chimeras, in Examples 2-4, also showed that chimeric viruses containing structural protein genes from wild-type DEN-3 or DEN-4 virus within the DEN-2 PDK-53 backbones, are suitable vaccine candidates which retain all of the attenuated phenotypic markers of the DEN-2 PDK-53 viruses (Table 14), while providing immunogenicity against DEN-3 or DEN-4 virus. The strategy described herein of using a genetic background that contains the determinants of attenuation in nonstructural regions of the genome to express the structural protein genes of heterologous viruses has lead to development of live, attenuated flavivirus vaccine candidates that express wild-type structural protein genes of optimal immunogenicity. Thus, vaccine candidates for immunogenic variants of multiple flaviviral pathogens can be designed.

Viruses used in the chimeras described herein are typically grown using techniques known in the art. Virus plaque titrations are then performed and plaques counted in order to assess the viability and phenotypic characteristics of the growing cultures. Wild type viruses are passaged through cultured cell lines to derive attenuated candidate starting materials.

Chimeric infectious clones are constructed from the various dengue serotype clones available. The cloning of virus-specific cDNA fragments can also be accomplished, if desired. The cDNA fragments containing the structural protein or nonstructural protein genes are amplified by reverse transcriptase-polymerase chain reaction (RT-PCR) from dengue virus RNA with various primers. Amplified fragments are cloned into the cleavage sites of other intermediate clones. Intermediate, chimeric dengue virus clones are then sequenced to verify the accuracy of the inserted dengue virus-specific cDNA.

Full genome-length chimeric plasmids constructed by inserting the structural protein or nonstructural protein gene region of dengue serotype viruses into vectors are obtainable using recombinant techniques well known to those skilled in the art.

Nucleotide and Amino Acid Analysis

The nucleotide sequence for DEN-2 16681 and corresponding PDK-53-V are provided in SEQ ID NO:13 and SEQ ID NO:15, respectively. Amino acid sequences for DEN-2 16681 and corresponding PDK-53-V are provided in SEQ ID NO:14 and SEQ ID NO:16. The -E variant of PDK-53, which varies from PDK-53-V at nucleotide position 5270 and amino acid position 1725 of the polyprotein is further described in Table 3. A comparison of the critical nucleotide and amino acid substitutions that have been discovered between the parent strain and the attenuated virus is shown in Table 3. The sequence of the DEN-2 cDNA amplicons was amplified from DEN-2 viral genomic RNA by reverse transcriptase-polymerase chain reaction (RT-PCR).

Unlike PDK-53, which contains no amino acid mutations in the E protein relative to wild type dengue-2 virus, the Mahidol DEN-1, DEN-3 and DEN-4 attenuated viruses all have amino acid mutations in the E protein (Tables 2, 4 & 5). The wild-type DEN-3 16562 listed in the sequence listing (nucleotide sequence, SEQ ID NO:19; amino acid sequence, SEQ ID NO:20) was shown to comprise traces of a variant comprising a T at nucleotide position 1521 which directs incorporation of a leucine at polyprotein position 476, amino acid residue position 476 of the E protein.

Each of the latter three viruses possess a Glu-to-Lys (parent-to-vaccine) mutation in the E protein, although the mutation is located at a different amino acid residue in the E protein. This substitution causes a shift from a negatively charged amino acid to a positively charged one. The Glu-to-Lys substitution in the E protein of DEN-4 vaccine virus was the only mutation present in the E protein, while the E proteins of DEN-1 and DEN-3 vaccine viruses had five and three amino acid mutations, respectively.

The NS1-53 mutation in the DEN-2 PDK-53 vaccine virus is significant for the attenuated phenotype of this virus, because the NS1-53-Gly of the DEN-2 16681 virus is conserved in nearly all flaviviruses, including the tick-borne viruses, sequenced to date. The Mahidol DEN-4 vaccine virus also contains an amino acid mutation in the NS1 protein at position 253. This locus, which is a Gln-to-His mutation in DEN-4 PDK-48 vaccine virus is Gln in all four wild serotypes of dengue virus. This Gln residue is unique to the dengue viruses within the flavivirus genus. The NS1 protein is a glycoprotein that is secreted from flavivirus-infected cells. It is present on the surface of the infected cell and NS1-specific antibodies are present in the serum of virus-infected individuals. Protection of animals immunized with NS1 protein or passively with NS1-specific antibody has been reported. The NS1 protein appears to participate in early viral RNA replication.

The mutations that occurred in the NS2A, NS2B, NS4A, and NS4B proteins of the DEN-1, -2, -3 and -4 attenuated strains were all conservative in nature. The NS4A-75 and NS4A-95 mutations of DEN-2 and DEN-4 vaccine viruses, respectively, occurred at sites of amino acid conservation among dengue viruses, but not among flaviviruses in general.

The flaviviral NS3 protein possesses at least two recognized functions: the viral proteinase and RNA helicase/NTPase. The 698-aa long (DEN-2 virus) NS3 protein contains an amino-terminal serine protease domain (NS3-51-His, -75-Asp, -135-Ser catalytic triad) that is followed by sequence motifs for RNA helicase/NTPase functions (NS3-196-GAGKT (SEQ ID NO:147), -284-DEAH, -459-GRIGR (SEQ ID NO:148)). None of the mutations in the NS3 proteins of DEN-1, DEN-2, or DEN-3 virus occurred within a recognized motif. The NS3-510 Tyr-to-Phe mutation in DEN-1 PDK-13 virus was conservative. Since the wild-type DEN-2, -3 and -4 viruses contain Phe at this position, it is unlikely that the Tyr-to-Phe mutation plays a role in the attenuation of DEN-1 virus. The NS3-182 Glu-to-Lys mutation in DEN-1 PDK-13 virus occurred at a position that is conserved as Asp or Glu in most mosquito-borne flaviviruses and it may play some role in attenuation. This mutation was located 15 amino acid residues upstream of the GAGKT (SEQ ID NO:147) helicase motif. As noted in previous reports, the NS3-250-Glu in DEN-2 16681 virus is conserved in all mosquito-borne flaviviruses except for yellow fever virus.

Method of Administration

The viral chimeras described herein are individually or jointly combined with a pharmaceutically acceptable carrier or vehicle for administration as an immunogen or vaccine to humans or animals. The terms "pharmaceutically acceptable carrier" or "pharmaceutically acceptable vehicle" are used herein to mean any composition or compound including, but not limited to, water or saline, a gel, salve, solvent, diluent, fluid ointment base, liposome, micelle, giant micelle, and the like, which is suitable for use in contact with living animal or human tissue without causing adverse physiological responses, and which does not interact with the other components of the composition in a deleterious manner.

The immunogenic or vaccine formulations may be conveniently presented in viral PFU unit dosage form and prepared by using conventional pharmaceutical techniques. Such techniques include the step of bringing into association the active ingredient and the pharmaceutical carrier(s) or excipient(s). In general, the formulations are prepared by uniformly and intimately bringing into association the active ingredient with liquid carriers. Formulations suitable for parenteral administration include aqueous and non-aqueous sterile injection solutions which may contain anti-oxidants, buffers, bacteriostats and solutes which render the formulation isotonic with the blood of the intended recipient, and aqueous and non-aqueous sterile suspensions which may include suspending agents and thickening agents. The formulations may be presented in unit-dose or multi-dose containers, for example, sealed ampoules and vials, and may be stored in a freeze-dried (lyophilized) condition requiring only the addition of the sterile liquid carrier, for example, water for injections, immediately prior to use. Extemporaneous injection solutions and suspensions may be prepared from sterile powders, granules and tablets commonly used by one of ordinary skill in the art.

Preferred unit dosage formulations are those containing a dose or unit, or an appropriate fraction thereof, of the administered ingredient. It should be understood that in addition to the ingredients particularly mentioned above, the formulations of the present invention may include other agents commonly used by one of ordinary skill in the art.

The immunogenic or vaccine composition may be administered through different routes, such as oral or parenteral, including, but not limited to, buccal and sublingual, rectal, parenteral, aerosol, nasal, intramuscular, subcutaneous, intradermal, and topical. The composition may be administered in different forms, including, but not limited to, solutions, emulsions and suspensions, microspheres, particles, microparticles, nanoparticles and liposomes. It is expected that from about 1 to about 5 doses may be required per immunization regimen. Initial doses may range from about 100 to about 50,000 PFU, with a preferred dosage range of about 500 to about 20,000 PFU, a more preferred dosage range of from about 1000 to about 12,000 PFU and a most preferred dosage range of about 1000 to about 4000 PFU. Booster injections may range in dosage from about 100 to about 20,000 PFU, with a preferred dosage range of about 500 to about 15,000, a more preferred dosage range of about 500 to about 10,000 PFU, and a most preferred dosage range of about 1000 to about 5000 PFU. For example, the volume of administration will vary depending on the route of administration. Intramuscular injections may range in volume from about 0.1 ml to 1.0 ml.

The composition may be stored at temperatures of from about −100° C. to about 4° C. The composition may also be stored in a lyophilized state at different temperatures including room temperature. The composition may be sterilized through conventional means known to one of ordinary skill in the art. Such means include, but are not limited to, filtration. The composition may also be combined with bacteriostatic agents, such as thimerosal, to inhibit bacterial growth.

Administration Schedule

The immunogenic or vaccine composition described herein may be administered to humans, especially individuals traveling to regions where dengue virus infection is present, and also to inhabitants of those regions. The optimal time for administration of the composition is about one to three months before the initial infection. However, the composition may also be administered after initial infection to ameliorate disease progression, or after initial infection to treat the disease.

Adjuvants

A variety of adjuvants known to one of ordinary skill in the art may be administered in conjunction with the chimeric virus in the immunogen or vaccine composition of this invention. Such adjuvants include, but are not limited to, the following: polymers, co-polymers such as polyoxyethylene-polyoxypropylene copolymers, including block co-polymers, polymer P1005, Freund's complete adjuvant (for animals), Freund's incomplete adjuvant; sorbitan monooleate, squalene, CRL-8300 adjuvant, alum, QS 21, muramyl dipeptide, CpG oligonucleotide motifs and combinations of CpG oligonucleotide motifs, trehalose, bacterial extracts, including mycobacterial extracts, detoxified endotoxins, membrane lipids, or combinations thereof.

Nucleic Acid Sequences

Nucleic acid sequences of the DEN-1 16007 (SEQ ID NO:1), DEN-1 PDK-13 (SEQ ID NO:3), DEN-2 16681 (SEQ ID NO:13), DEN-2 PDK-53 (SEQ ID NO:15), DEN-3 16562 (SEQ ID NO:19), DEN-3 PGMK-30/FRhL-3 (SEQ ID NO:21), DEN-4 1036 (SEQ ID NO:23) and DEN-4 PDK-13 (SEQ ID NO:25) viruses are useful for designing nucleic acid probes and primers for the detection of dengue virus in a sample or specimen with high sensitivity and specificity. Probes or primers corresponding to each viral subtype can be used to detect the presence of DEN-1 virus, DEN-3 virus and DEN-4 virus, respectively, to detect dengue virus infection in general in the sample, to diagnose infection with dengue virus, to distinguish between the various dengue virus subtypes, to quantify the amount of dengue virus in the sample, or to monitor the progress of therapies used to treat a dengue virus infection. The nucleic acid and corresponding amino acid sequences are also useful as laboratory research tools to study the organisms and the diseases and to develop therapies and treatments for the diseases.

Nucleic acid probes selectively hybridize with nucleic acid molecules encoding the DEN-1, DEN-3 and DEN-4 viruses or complementary sequences thereof. By "selective" or "selectively" is meant a sequence which does not hybridize with other nucleic acids to prevent adequate detection of the dengue virus. Therefore, in the design of hybridizing nucleic acids, selectivity will depend upon the other components present in a sample. The hybridizing nucleic acid should have at least 70% complementarity with the segment of the nucleic acid to which it hybridizes. As used herein to describe nucleic acids, the term "selectively hybridizes" excludes the occasional randomly hybridizing nucleic acids, and thus, has the same meaning as "specifically hybridizing." The selectively hybridizing nucleic acid of this invention can have at least 70%, 80%, 85%, 90%, 95%, 97%, 98%, and 99% complementarity with the segment of the sequence to which it hybridizes, preferably 85% or more.

The present invention also contemplates sequences, probes and primers which selectively hybridize to the encoding nucleic acid or the complementary, or opposite, strand of the nucleic acid. Specific hybridization with nucleic acid can occur with minor modifications or substitutions in the nucleic acid, so long as functional species-specific hybridization capability is maintained. By "probe" is meant nucleic acid sequences that can be used as probes or primers for selective hybridization with complementary nucleic acid sequences for their detection or amplification, which probes can vary in length from about 5 to 100 nucleotides, or preferably from about 10 to 50 nucleotides, or most preferably about 18–24 nucleotides. Therefore, the terms "probe" or "probes" as used herein are defined to include "primers." Isolated nucleic acids are provided herein that selectively hybridize with the species-specific nucleic acids under stringent conditions and should have at least five nucleotides complementary to the sequence of interest as described in *Molecular Cloning: A Laboratory Manual,* 2nd Ed., Sambrook, Fritsch and Maniatis, Cold Spring Harbor Laboratory, Cold Spring Harbor, N.Y., (1989).

If used as primers, the composition preferably includes at least two nucleic acid molecules which hybridize to different regions of the target molecule so as to amplify a desired region. Depending on the length of the probe or primer, the target region can range between 70% complementary bases and full complementarity and still hybridize under stringent conditions. For example, for the purpose of detecting the presence of the dengue virus, the degree of complementarity between the hybridizing nucleic acid (probe or primer) and the sequence to which it hybridizes is at least enough to distinguish hybridization with a nucleic acid from other organisms.

The nucleic acid sequences encoding the DEN-1, DEN-3 or DEN-4 virus can be inserted into a vector, such as a plasmid, and recombinantly expressed in a living organism to produce recombinant dengue virus peptides and/or polypeptides.

Nucleic Acid Detection Methods

A rapid genetic test that is diagnostic for each of the vaccine viruses described herein is provided by the current invention. This embodiment of the invention enhances analyses of viruses isolated from the serum of vaccinated humans who developed a viremia, as well as enhancing characterization of viremia in nonhuman primates immunized with the Mahidol candidate vaccine viruses.

As provided in the complete nucleotide sequences of the wild-type parental and vaccine strains, and in the primer sequences provided in Table 16, the current invention comprises viruses specific probes and primers to detect one or more of the mutations that have been identified in the genome of each vaccine virus. Specific detection of two or more virus specific loci allows specific identification of the particular vaccine circulating in the serum of a vaccinee. Examples of such probes specifically designed to allow detection of each of the DEN-1, DEN-2, DEN-3 and DEN-4 vaccine virus-specific loci in a TaqMan assay are provided in Table 16.

These sequences include a diagnostic TaqMan probe that serves to report the detection of the cDNA amplicon amplified from the viral genomic RNA template by using a reverse-transcriptase/polymerase chain reaction (RT/PCR), as well as the forward (F in Table 16) and reverse (R in Table 16) amplimers that are designed to amplify the cDNA amplicon, as described below. In certain instances, one of the amplimers has been designed to contain a vaccine virus-specific mutation (underlined residues in Table 16) at the 3'-terminal end of the amplimer, which effectively makes the test even more specific for the vaccine strain because extension of the primer at the target site, and consequently amplification, will occur only if the viral RNA template contains that specific mutation. The probes and primers listed in Table 15 and Table 16 serve as examples of useful diagnostic sequences and are not intended to limit the design or scope of other probe and amplimer sequences that might be designed to detect the Mahidol vaccine virus-specific genetic mutations.

A recently developed, automated PCR-based nucleic acid sequence detection system is the TaqMan assay (Applied Biosystems), which is becoming widely used in diagnostic laboratories. The TaqMan assay is a highly specific and sensitive assay that permits automated, real time visualization and quantitation of PCR-generated amplicons from a sample nucleic acid template. TaqMan can determine the presence or absence of a specific sequence. In this assay, a forward and a reverse primer are designed to anneal upstream and downstream of the target mutation site, respectively. A specific detector probe, which is designed to have a melting temperature of about 10° C. higher than either of the amplimers and containing the vaccine virus-specific nucleotide mutation or its complement (depending on the strand of RT/PCR amplicon that is being detected), constitutes the third primer component of this assay.

The probe is a fluorescent detector or reporter oligonucleotide that contains a 5'-reporter dye and a 3'-quencher dye. The 5' end of the nucleotide is linked to one of a number of different fluorescent reporter dyes, such as FAM (6-carboxyfluorescein) or TET (tetrachloro-6-carboxyfluorescein). At the 3'-end of the probe, the quenching dye TAMRA (6-carboxytetramethylrhodamine) is attached via a linker. The quenching dye suppresses the fluorescence of the reporter dye in the intact probe, where both dyes are in close proximity. If the probe-specific target sequence is present in the RT/PCR amplicon, the probe will anneal between the forward and reverse primer sites in the amplicon. If the probe hybridizes to the target sequence, the 5'-3' nuclease activity of AmpliTaq Gold DNA polymerase (Applied Biosystems) cleaves the probe between the reporter dye and the quencher dye. The polymerase will not digest free probe. Because the polymerase diplaces the probe, polymerization and PCR amplification continue. Once separated from the quencher dye, the reporter dye produces a fluorescence that is measured by the ABI PRISM Sequence Detection System. If the probe-specific target sequence is present in the amplicon, the level of fluorescence increases with, and is automatically measured at, each amplifying PCR cycle.

A probe designed to specifically detect a mutated locus in one of the Mahidol vaccine viral genomes will contain the vaccine-specific nucleotide in the middle of the probe. This probe will result in detectable fluorescence in the TaqMan assay if the viral RNA template is vaccine virus-specific. However, genomic RNA templates from wild-type DEN viruses will have decreased efficiency of probe hybridization because of the single nucleotide mismatch (in the case of the parental viruses DEN viruses) or possibly more than one mismatch (as may occur in other wild-type DEN viruses) and will not result in significant fluorescence. The DNA polymerase is more likely to displace a mismatched probe from the RT/PCR amplicon template than to cleave the mismatched probe to release the reporter dye (TaqMan Allelic Discrimination assay, Applied Biosystems).

A more recently developed strategy for diagnostic genetic testing makes use of molecular beacons (Tyagi and Kramer, *Nature Biotechnology* 14:303–308(1996)). The molecular beacon strategy also utilizes primers for RT/PCR amplification of amplicons, and detection of a specific sequence within the amplicon by a probe containing reporter and quencher dyes at the probe termini. In this assay, the probe forms a stem-loop structure. The 5'- and 3'-terminal reporter dye and quencher dye, respectively, are located at the termini of the short stem structure, which brings the quencher dye in close juxtaposition with the reporter dye. The stem-structure is melted during the denaturation step of the RT/PCR assay. If the target viral RNA contains the target sequence and is amplified by the forward and reverse amplimers, the opened loop of the probed hybridizes to the target sequence during the annealing step of the cycle. When the probe is annealed to either strand of the amplicon template, the quencher and reporter dyes are separated, and the fluorescence of the reporter dye is detected. This is a real-time identification and quantitation assay that is very similar to to the TaqMan assay. The molecular beacons assay employs quencher and reporter dyes that differ from those used in the TaqMan assay.

The present invention is further illustrated by the following non-limiting examples, which are not to be construed in any way as imposing limitations upon the scope thereof. On the contrary, it is to be clearly understood that resort may be had to various other embodiments, modifications, and equivalents thereof which, after reading the description herein, may suggest themselves to those skilled in the art without departing from the spirit of the present invention or the scope of the appended claims.

EXAMPLE 1

Preparation of a Chimeric Dengue-1 Vaccine: PDK-53/Dengue-1

Viruses and Cell Cultures

Wild-type DEN-1 16007 and DEN-2 16681 viruses were available in the virus collection at the Centers for Disease Control and Prevention (Atlanta, Ga.). DEN-1 16007 virus was recovered from the serum of a patient with DHF/DSS in 1964 in Thailand. The virus was isolated following three passages in grivet monkey kidney BS-C-1 cells and one passage in LLC-$MK_2$ cells, passaged twice in *Toxorhynchites amboinensis* mosquitoes, and then passaged in primary dog kidney (PDK) cells at the Center for Vaccine Development, Mahidol University, Thailand, to derive the candidate DEN-1 PDK-13 vaccine virus (Yoksan et al., "Dengue virus vaccine development: study on biological markers of uncloned dengue 1–4 viruses serially passaged in primary kidney cells," pp. 35–38, In *Arbovirus research in Australia, Proceedings of the Fourth Symposium. CSIRO/QIMR*, Brisbane, Australia (1986); Bhamarapravati & Sutee, *Vaccine* 18: 44–47 (2000)). A single LLC-$MK_2$ passage of this candidate vaccine virus (lot Mar. 10, 1989) was used, unless otherwise mentioned. Following the aforementioned mosquito passages, the 16007 virus was passaged once in LLC-$MK_2$ cells for use.

Viruses were grown in LLC-$MK_2$ and C6/36 cells in Dulbecco's modified minimal essential medium (DMEM) containing penicillin/streptomycin and 5% fetal bovine serum (FBS). Virus plaque titrations were performed in 6-well plates of confluent Vero or LLC-$MK_2$ cells as described previously (Miller et al., *Am. J. Trop. Med. &Hyg.* 35: 1302–1309 (1986)). The first 4-ml overlay medium—containing 1% SeaKem LE agarose (FMC BioProducts, Rockland, Me.) in nutrient medium (0.165% lactalbumin hydrolysate [Difco Laboratories, Detroit, Mich.]), 0.033% yeast extract [Difco], Earl's balanced salt solution, 25 mg/L of gentamycin sulfate [Bio Whittaker, Walkersville, Md.], 1.0 mg/L of amphotericin B [Fungizone, E. R. Squibb & Sons, Princeton, N.J.], and 2% FBS)—was added after adsorption of the 200-μl virus inoculum for 1.5 h at 37° C. Following incubation at 37° C. for 7 days, a second 2-ml overlay containing an additional 80 μg/ml of neutral red vital stain (GIBCO-BRL, Gaithersburg, Md.) was added. Plaques were counted 8 to 11 days after infection.

Construction of Chimeric D2/1 Infectious Clones pD2-16681-P48, pD2-PDK53-E48, pD2-PDK53-V48 Vectors Three DEN-2 vectors were used for construction of the chimeric D2/1 clones. These were modified from the DEN-2 infectious clones reported by Kinney et al. (*Virology* 230: 300–308 (1997)). Clone pD2-16681-P48 was modified from pD2/IC-30P-A to contain cloning sites MluI and NgoMIV at nucleotide positions 451 and 2380, respectively. The same cloning sites were introduced into both DEN-2 PDK-53 virus-specific clones, pD2/IC-130Vx-4 and -130Vc-K, and the modified clones were designated as pD2-PDK53-E48 and pD2-PDK53-V48, respectively. Two cloning errors were found in the original pD2/IC-130Vx-4 and -130Vc-K at nt-6665 and nt-8840. These defects were corrected in pD2-PDK53-E48 and -V48. The introduced NgoMIV cloning site resulted in two nucleotide mutations (nt 2381 and 2382; TG to CC), which encoded a Val-to-Ala substitution at E-482. The nucleotide changes introduced at the MluI site were silent. The MluI site introduced at the C/prM junction was used to clone the prM-E genes of heterologous viruses.

Chimeric pD2/1-PP, -EP, -VP, -PV, -EV, and -VV

Two intermediate DEN-2 clones, pD2I-P and pD2I-E, were constructed by deleting the HpaI (nt-2676) to XbaI (3' terminus of viral genomic cDNA) fragments of pD2-16681-P48 and pD2-PDK53-E48, respectively. These intermediate clones were used to subclone DEN-1 virus-specific cDNA fragments. The cDNA fragments containing the C-prM-E genes of DEN-1 16007 or PDK-13 virus were amplified by reverse transcriptase-polymerase chain reaction (RT-PCR) from DEN-1 viral RNA with primers DEN-Bgl.5NC (5'-TAGAGAGCAGATCTCTG-3' (SEQ ID NO:31); conserved sequence in the 5'NCR of dengue viral genomes, underlined sequence is a BglII site) and cD1-2394.Ngo: (5'-TGTGACCATGCCGGCTGCGATGCACTCACCGA-3' (SEQ ID NO:32); underlined NgoMIV site followed by complementary sequence near the 3' end of the E gene of DEN-1 virus). Amplified fragments were cloned into the BglII-NgoMIV sites of the intermediate pD2I-P and pD2I-E clones. Intermediate, chimeric pD2/1 clones were sequenced to verify the accuracy of the inserted DEN-1 virus-specific cDNA. Fragments excised from the intermediate pD2/1 clones with SstI (preceding the T7 promoter) and NgoMIV were cloned into the full genome-length DEN-2 vectors, pD2-16681-P48, pD2-PDK53-E48, and pD2-PDK53-V48. Six full genome-length chimeric pD2/1 plasmids were constructed by inserting the C-prM-E gene region of DEN-1 16007 or PDK-13 virus into these three vectors (FIG. 1). The plasmids were designated pD2/1-XY and their virus derivatives were designated DEN2/1-XY, where X=the infectious DEN-2 clone background (P=parental 16881 clone, E=PDK53-E variant, V=PDK53-V variant) and Y=DEN-1 virus-specific C-prM-E insert (P=parental 16007 strain, V=PDK-13 vaccine candidate). The PDK53-E backbone contains three DEN-2 PDK-53 virus-specific amino acid mutations (NS1-53-Asp, NS2A-181-Phe and NS4A-75-Ala) as well as the 5'NC-57 mutation of PDK-53 virus. The PDK53-V backbone contains these same PDK-53 virus-specific loci plus the additional PDK-53 virus-specific NS3-250-Val locus.

Recovery of Recombinant Viruses

All recombinant plasmids were grown in *Escherichia coli* XLI-Blue cells. Recombinant viral RNA was transcribed and capped with the cap analog $m^7$ GpppA from 200–400 ng of XbaI-linearized cDNA, and transfected into 3-4×$10^6$ LLC-$MK_2$ or BHK-21 cells by electroporation. Transfected cells were transferred to 75-$cm^2$ flasks in DMEM medium containing 10% FBS. Viral proteins expressed in the transfected cells were analyzed by indirect immunofluorescence assay (IFA). Virus-infected cells were fixed in ice-cold acetone for 30 min. DEN-1 and DEN-2 virus-specific monoclonal antibodies 1F1 and 3H5, respectively, were used in the assay, and binding was detected with fluorescein-labeled goat anti-mouse antibody. Viruses were harvested after 8 to 10 days, and were then passaged in LLC-$MK_2$ cells once (DEN-2-16681-P48, DEN-2 PDK53-E48 and -V48, DEN-2/1-PP, -EP, and -VP) or twice (DEN-2/1-PV, -EV, and -VV) to obtain working seeds. D2/1-EV and -VV viruses were passaged a third time in LLC-$MK_2$ cells to obtain higher viral titers required for challenge or immunization of mice.

Characterization of the Replication Phenotypes of Chimeric Viruses in Cell Cultures Plaque sizes were measured 10 days after infection in LLC-$MK_2$ cells. Mean plaque diameters were calculated from 10 plaques for each virus. Viral growth curves were performed in 75-$cm^2$ flasks of LLC-$MK_2$ or C6/36 cells at approximately 0.001 multiplicity of infection (m.o.i.). After adsorption for 2 h, 30 ml of DMEM medium (for LLC-$MK_2$ cells) or overlay nutrient medium (for C6/36 cells) containing 5% FBS and penicillin/streptomycin was added, and the cultures were incubated in 5% $CO_2$ at 37° C. or 29° C., respectively. Aliquots of culture medium were harvested at 48-h intervals for 12 days, adjusted to 12.5% FBS, and stored at −80° C. prior to titration.

Temperature sensitivity was tested in LLC-$MK_2$ cells. Cells grown in two sets of 75-$cm^2$ flasks were infected and incubated as described for the growth curve study. One set of cultures was incubated for 8 days at 37° C., the other at 38.7° C. The ratio of virus titer at 38.7° C. versus the titer at 37° C. was calculated. Virus was designated as temperature-sensitive if the virus titer at 38.7° C. was reduced 60% or greater, relative its titer at 37° C.

Sequencing of Viral cDNA

Viral RNA was extracted from virus seed or by using the QIAmp Viral RNA kit (Qiagen, Valencia, Calif.). DEN-1 virus-specific primers were based on the published data of the Singapore strain S275/90 (Fu et al., *Virology* 88: 953–958 (1992)). Five to 7 overlapping viral cDNA fragments were amplified by RT-PCR with the Titan One-Tube RT-PCR System (Roche Molecular Biochemicals, Indianapolis, Ind.). Both strands of the cDNA amplicons were sequenced directly. For sequencing of the DEN-1 PDK-13 viral genome, template genomic RNA was extracted directly from a vial of the candidate DEN-1 PDK-13 vaccine (lot Mar. 10, 1989). The 5'- and 3'-terminal sequences of the DEN-1 16007 and DEN-1 PDK-13 viral genomes were determined with the 5' RACE kit (GIBCO BRL) and by tailing the genomic RNA with poly(A). Automated sequencing was performed as recommended on a PRISM 377 sequencer (Perkin-Elmer/Applied Biosystems, Foster City, Calif.).

Mouse Studies

Litters of newborn, 1-day-old outbred white ICR mice were inoculated intracranially with 5,000 PFU of virus in a volume of 30 ml. They were observed daily for paralysis and death, and surviving mice were individually weighed once each week for 5 weeks.

Neutralizing antibody responses were tested in 3-week-old ICR mice. They were inoculated intraperitoneally with $10^4$ PFU of virus, and were boosted with the same amount of virus 3 weeks or 6 weeks later. Mice were bled 2 days prior to the boost and 3 weeks after boosting.

The ICR strain of inbred mice used above are not usually fatally susceptible to challenge with wild-type DEN-1 virus. Therefore, to fully test the ability of the DEN-2/1 viral chimera to induce an effective immune response, it was necessary to utilize inbred AG-129 mice, which lack receptors for both interferon alpha/beta and interferon gamma (Muller et al., Science 264:1918–1921 (1994)), as these mice have been found to be susceptible to intraperitoneal challenge with high doses of wild-type DEN-1 virus, strain Mochizuki. Therefore, 3.5–4.5-week-old inbred AG-129 mice were immunized intraperitoneally with $10^4$ PFU of wild-type DEN-1 16007, Mahidol candidate vaccine DEN-1 PDK-13, chimeric DEN-2/1-EP or chimeric DEN-2/1-VP virus. These immunized mice were challenged intraperitoneally with a lethal dose of DEN-1 Mochizuki virus.

Neutralization Assays

Mouse serum samples were tested for neutralizing antibodies by serum-dilution plaque-reduction neutralization test (PRNT). Sixty PFU of DEN-1 16007 virus was incubated with serial 2-fold dilutions of heat-inactivated (56° C. for 30 min) mouse serum specimens overnight at 4° C. The neutralizing antibody titer was identified as the highest serum dilution that reduced the number of virus plaques in the test by 50% or greater.

Results

To assess the potential of infectious cDNA clones derived from the two variants of DEN-2 16681 PDK-53 virus (PDK-53-E and PDK-53-V) to serve as vectors for vaccine development, we engineered chimeric DEN-2/DEN-1 cDNA clones (D2/1-EP, D2/1-VP, D2/1-EV, and D2/1-VV) containing the structural genes (C-prM-E) of wild-type DEN-1 16007 virus or its vaccine derivative, strain PDK-13, within the backbone of these two vectors (FIG. 1). Two other chimeric clones, D2/1-PP and D2/1-PV, containing the structural genes (C-prM-E) of DEN-1 16007 or PDK-13 virus in the backbone of wild-type DEN-2 16681 virus, were also constructed for comparison (FIG. 1). We sequenced the entire full-length genomic cDNA in all of the infectious clones. A silent cDNA artifact was incorporated into the chimeric clones at nt-297 (T-to-C). A silent mutation at nt-1575 (T-to-C) was engineered into all of the chimeric clones to remove the natural XbaI site in the E gene of the DEN-1 virus.

Titers after transfection of LLC-$MK_2$ or BHK-21 cells were $10^4$–$10^6$ PFU/ml for the chimeric viruses D2/1-PP, -EP, and -VP containing the C-prM-E of DEN-1 16007 virus. These titers increased to $10^{6.5}$–$10^{7.5}$ PFU/ml after a single passage in LLC-$MK_2$ cells, comparable to the titers obtained for their parental viruses. Lower titers of $10^2$–$10^4$ PFU/ml were obtained in transfected cells for the chimeric DEN-2/1-PV, -EV, and -VV viruses containing the C-prM-E of DEN-1 PDK-13 virus. D2/1-PV virus reached $10^6$ PFU/ml after 2 passages in LLC-$MK_2$ cells, whereas D2/1-EV and -VV viruses reached titers of $10^{3.3}$–$10^{5.3}$ PFU/ml after two or three passages. Cells infected with any of the chimeric DEN-2/1 viruses were positive by IFA with monoclonal antibody 1F1 (specific for DEN-1 E protein) and negative with monoclonal antibody 3H5 (specific for DEN-2 E protein), indicating that appropriate DEN-1 E proteins were expressed by the chimeras. The DEN-2/1-PP, DEN-2/1-EP, and DEN-2/1-VP viral genomes were fully sequenced by directly analyzing overlapping RT-PCR fragments amplified from genomic viral RNA extracted from master seeds. All three genomes had the expected sequence.

Growth of the Chimeric Viruses in LLC-$MK_2$ and C6/36 Cell Cultures

All of the chimeric DEN-2/1 viruses produced smaller plaques, relative to the 6.8±0.4-mm plaque of wild-type DEN-1 16007 virus in LLC-$MK_2$ cells (FIG. 2A). Both DEN-2/1-EP (3.1±0.3 mm) and -VP (2.8±0.3 mm) viral plaques were similar in size to those of DEN-1 PDK-13 virus (2.9±0.3 mm). The chimeric viruses DEN-2/1-PV, DEN-2/1-EV, and DEN-2/1-VV containing the C-prM-E of DEN-1 PDK-13 virus formed tiny (1.3±0.3 mm) or pinpoint (<1 mm) plaques. The DEN-2 16681-P48 virus produced 3.5±0.3-mm plaques that were similar to plaques of wild-type DEN-2 16681 virus. The DEN-2 PDK53-V48 virus formed plaques that were smaller and fuzzier than those of the DEN-2 PDK53-E48 virus. The 5.1±0.3-mm plaques of DEN-2/1-PP virus were larger than those of the other chimeric viruses, but smaller than those of DEN-1 16007 virus.

Viruses were tested for temperature sensitivity in LLC-$MK_2$ cells. Temperature sensitivity was determined on day 8 or 10 after infection as indicated in FIG. 2B. Temperature sensitivity was based on the reduction of virus titers at 38.7° C. from those at 37° C. Temperature sensitivity was calculated from measurements taken in at least 3 experiments.

The DEN-2 PDK53-V variant (D2-PDK53-V48) was more temperature sensitive than DEN-2 PDK53-E virus (D2-PDK53-E48) and DEN-2 16681 virus (DEN-2-16681-P48) was somewhat temperature sensitive (70–87% titer reduction at 38.7° C.). Multiple temperature sensitivity tests for DEN-2-PDK53-E48 virus resulted in 83%–97% growth reduction. The titer of DEN-1 16007 virus was reduced by 40% or less at 38.7° C., making it the least-temperature sensitive virus in this study. All of the chimeric viruses were temperature sensitive relative to DEN-1 16007 virus, and were at least as temperature-sensitive as PDK-13.

All of the DEN-1, DEN-2, and chimeric D2/1 viruses reached peak titers between 8 and 10 days after infection in LLC-$MK_2$ cells (FIG. 2B). The clone-derived viruses DEN-2-16681-P48, DEN-2-PDK53-E48, and DEN-2-PDK53-V48 replicated to $10^{7.0}$ PFU/ml or greater, as did DEN-2 16681 and PDK-53 viruses. Although reaching similar peak titer, DEN-2-PDK53-V48 virus replicated slower than the DEN-2-PDK53-E48 virus during the first 4 days after infection. Chimeric DEN-2/1-PP, DEN-2/1-EP, DEN-2/1-VP, and DEN-2/1-PV viruses reached peak titers over $10^{6.7}$ PFU/ml, comparable to the peak titers of their parental DEN-1 and DEN-2 viruses. Chimeric DEN-2/1-EV and -VV viruses, which had peak titers of $10^{5.6}$–$10^{5.9}$ PFU/ml or lower in several separate experiments, replicated less efficiently than the other viruses.

The PDK-13 virus-specific chimeras result in lower virus titers recovered from transfected cells, relative to the 16007 virus-specific chimeras. Previous experiences with DEN-2/DEN-1 and DEN-2/DEN-4 chimeras indicate that chimeric viruses which exhibit crippled replication during transfection and later develop high virus titers after passage in cell culture often accrued unexpected mutations. Viruses of increased replicative ability may arise through selection of subpopulations of virus variants, resulting from incorporation errors during in vitro transcription of cDNA. Chimeric viruses that replicate well in transfected cells were more genetically stable after passage in LLC-MK$_2$ cells. Efficient replication with minimal passage in mammalian cell culture may be an important criterion of genetic stability and suitability for an infectious clone-derived vaccine virus.

Figure 3:
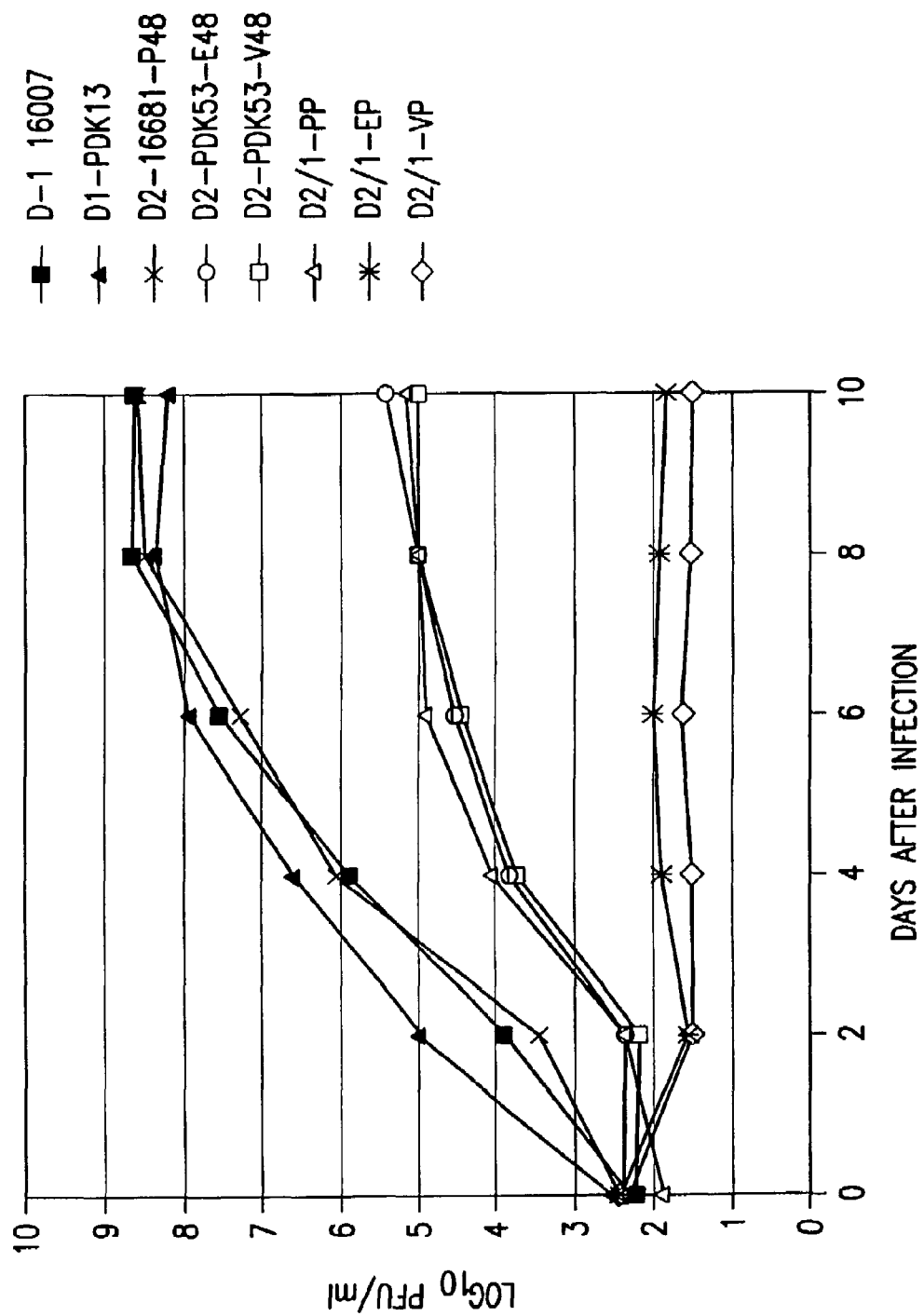
FIG. 3 shows the growth curves of DEN-1 16007, DEN-1 PDK-13, DEN-2 16681-P48, DEN-2 PDK53-E48, DEN-2 PDK53-V48 and chimeric DEN-2/DEN-1 viruses in C6/36 cells. Cells were infected at an approximate m.o.i. of 0.001 PFU/ml.

Viral growth curves in C6/36 cells were monitored following infection of C6/36 cells at an approximate multiplicity of 0.001 PFU/ml (FIG. 3). The three DEN-2 backbone viruses, DEN-2-16681-P48, DEN-2-PDK53-E48 and DEN-2-PDK53-V48, replicated like the original DEN-2 16681 virus and the two PDK-53 variants, respectively. Both DEN-2-PDK53-E48 and DEN-2-PDK53-V48 viruses replicated about 4000-fold less efficiently than the DEN-2-16681-P48, DEN-1 16007 and PDK-13 viruses in C6/36 cells. DEN-1 16007 and PDK-13 viruses replicated to high titers of $10^{8.7}$ and $10^{8.4}$ PFU/ml, respectively. The chimeric DEN-2/1-PP virus replicated to $10^{5.2}$ PFU/ml, which was equivalent to the peak titers of the two DEN-2-PDK53 variants. Replication of chimeric DEN-2/1-EP and DEN-2/1-VP viruses was very inefficient in C6/36 cells. These viruses reached peak titers of lower than $10^2$ PFU/ml.

Neurovirulence in Suckling Mice

Groups of newborn to one-day-old ICR mice (n=16) were inoculated intracranially with 5000 PFU of virus. Wild-type DEN-2 16681 virus was 100% fatal with average survival time at 14.1±1.6 days, while both clone-derived DEN-2-PDK53-E48 and DEN-2-PDK53-V48 viruses failed to kill any ICR mice. Unlike DEN-2 16681 virus, which typically kills 50% or greater of challenged mice, the wild-type DEN-1 16007 virus caused only a single fatality (21 days after challenge) in the ICR mice. The DEN-1 PDK-13 virus did not kill any of the ICR mice. DEN-1 16007 virus-infected ICR mice had significantly lower mean body weights (p<0.00003, Student's t test), relative to the control group inoculated with diluent, between 21–35 days after challenge. All of the ICR mouse groups challenged with five chimeric DEN-2/1 viruses (DEN-2/1-VV virus was not tested) had lower mean weights (p<0.02) when compared to the control group, but their mean weights were significantly greater (p<0.004) than the DEN-1 16007 group 28 days after infection. The mean body weights of ICR mouse groups challenged with $10^4$ PFU of DEN-1 16007 or PDK-13 virus were nearly identical to those of the ICR mice challenged with 5000 PFU of DEN-1 16007 virus between 7–35 days after challenge.

Immunogenicity of Chimeric DEN-2/1 Viruses in Mice

Outbred ICR Mice: To test the immunogenicity of the chimeric viruses, groups of 3-week-old ICR mice (n=8) were immunized intraperitoneally with $10^4$ PFU of virus in Experiment 1 and Experiment 2 (Table 7). In Experiment 1, the mice were bled 20 days after primary immunization and then boosted 2 days later. In Experiment 2, the mice were bled 41 days after primary immunization and boosted 2 days later. Table 7 shows the reciprocal, 50% plaque-reduction endpoint PRNT titers of the pooled serum samples from each immunized group. The range of individual titers for the eight mice in many of the groups is also shown. In both experiments, the reciprocal titer of the pooled serum from 16007 virus-immunized mice was 80 before boost and 2560 after boost. In both experiments, mice immunized with chimeric DEN-2/1-PP, -EP, or DEN-2/1-VP viruses had a pooled serum titer that was at least as high as those of the 16007 virus-immunized groups before (reciprocal titers of 40–160) and after (reciprocal titers of 2560–5210) boost. The immune responses of the mice in these virus groups were nearly equivalent in both Experiment 1 and Experiment 2.

The PDK-13 virus and all three of the chimeras containing the PDK-13 structural genes induced minimal or low reciprocal PRNT titers of 10–20 against DEN-1 16007 virus by 20 days after primary immunization in Experiment 1. A somewhat higher reciprocal PRNT titer of 40 was elicited by each of these viruses by 41 days after immunization in Experiment 2. The development of neutralizing antibodies was slower and of lower magnitude following immunization with PDK-13, DEN-2/1-PV, -EV, or -VV virus than with 16007, DEN-2/1-PP, -EP, or -VP virus in these mice. One mouse in the DEN-2/1-PV group in Experiment 1 and one mouse in each of the DEN-2/1-EV groups in both experiments failed to produce a detectable PRNT titer before boost. Boosted titers were also higher for the PDK-13, DEN-2/1-PV, -EV, and -VV-immunized groups in Experiment 2 (pooled reciprocal titers of 160–2560) than in Experiment 1 (pooled reciprocal titers of 80). Except for the DEN-2/1-PV group in Experiment 2, these boosted titers were lower than the boosted PRNT titers induced by wild-type 16007 virus and chimeric DEN-2/1-PP, -EP, and -VP viruses containing the structural genes of the wild-type DEN-1 16007 virus (Table 7). The high PRNT titer obtained for the pooled serum of the mice boosted with DEN-2/1-PV virus resulted from two mouse sera which had reciprocal titers of 2560 and 10,240. The remaining 6 mice in this group had reciprocal titers of 20 to 640, which were similar to the individual titers of mice in the PDK-13, DEN-2/1-EV, and -VV groups. The PDK-13, DEN-2/1-PV, DEN-2/1-EV, and DEN-2/1-VV viruses appeared to be less immunogenic than the 16007, DEN-2/1-PP, -EP, and -VP viruses in these outbred mice. Pooled serum samples from mice immunized with DEN-2-16681-P48, DEN-2-PDK-53-E48, or DEN-2-PDK-53-V48 virus did not contain detectable cross neutralizing antibody against DEN-1 16007 virus.

Inbred AG-129 Mice: To test the immunogenicity of the chimeric viruses, groups of 3.5–4.5-week-old inbred AG-129 mice were immunized intraperitoneally with $10^4$ PFU of wild-type DEN-1 16007, Mahidol candidate vaccine DEN-1 PDK-13, chimeric DEN-2/1-EP, or chimeric DEN-2/1-VP virus. At 26 days after primary immunization, pooled sera from mice immunized with chimeric DEN-2/1-EP or DEN-2/1-VP virus had reciprocal 70% serum dilution-plaque reduction neutralizing antibody titers (PRNT$_{70}$) of 80–160. These titers were equivalent (within 2-fold) of the neutralizing antibody response elicited by the candidate DEN-1 PDK-13 vaccine, but lower than the 640 titer elicited by the wild-type DEN-1 16007 virus. Control mice injected intraperitoneally with phosphate buffered saline had titers of less than 10. All mice were challenged intraperitoneally with $10^7$ PFU of wild-type, virulent DEN-1 virus, strain Mochizuki, at 28 days after primary immunization. All eleven of the control, non-immunized mice died within 21 days (average survival time of 11.5±4.2 days [mean±standard deviation]) after challenge, whereas all of the DEN-1 (16007, PDK-13, DEN-2/1-EP, DEN-2/1-VP) virus-immunized mice survived challenge with DEN-1 Mochizuki virus. At 34 days after challenge with DEN-1 Mochizuki, all of the virus-immunized mice had reciprocal PRNT$_{70}$ titers of 1280–2560. The chimeric DEN-2/1-EP and DEN-2/1-VP viruses were highly immunogenic and protective for AG-129 mice.

Nucleotide Sequence Analyses of DEN-1 16007 and PDK-13 Viral Genomes

We sequenced the genomes of wild-type DEN-1 16007 virus (GenBank accession number AF180817) and its PDK-13 vaccine derivative (accession number AF180818). There were 14 nucleotide and 8 encoded amino acid differences between 16007 and PDK-13 viruses (Table 2). Silent mutations occurred at genome nucleotide positions 1567, 2695, 2782, 7330, and 9445 in the E, NS1, NS4B, and NS5 genes. Unlike the candidate DEN-2 PDK-53 vaccine virus, which has no amino acid mutations in the E protein, the DEN-1 PDK-13 virus had five amino acid mutations in E, including E-130 Val-to-Ala, E-203 Glu-to-Lys, E-204 Arg-to-Lys, E-225 Ser-to-Leu, and E-447 Met-to-Val. Amino acid mutations in the nonstructural genes included NS3-182 Glu-to-Lys, NS3-510 Tyr-to-Phe, and NS4A-144 Met-to-Val. The PDK-13 virus-specific E-477-Val was incorporated into all of the chimeric constructs.

Immunization of Monkeys with Chimeric DEN-2/1 Viruses

The immunogenicity of the chimeric DEN-2/1-EP and DEN-2/1-VP viruses in adult crab-eating monkeys (*Macaca fascicularis*) was tested. Immunization of monkeys was accomplished by means of subcutaneous injection with $10^6$ PFU of chimeric DEN-2/1-EP or DEN-2/1-VP virus. Sera obtained from the immunized monkeys were analyzed for the presence of viremia by direct plaque assay of serum aliquots in LLC-MK$_2$ cell monolayers maintained under agarose overlay in 6-well plates, and by inoculation of serum aliquots into cultures of LLC-MK2 cells maintained in liquid medium. No infectious virus was identified in any of the monkey sera by either of these two classical assay methods. By these two virus assays, no viremia was detectable following immunization with either chimeric DEN-2/1-EP or DEN-2/1-VP virus. Monkey sera were tested for DEN-1 virus-specific neutralizing antibodies. At 30 days after primary immunization, sera from three individual monkeys immunized with chimeric DEN-2/1-EP virus had reciprocal 50% serum dilution-plaque reduction neutralizing antibody titers (PRNT$_{50}$) of 80, 160 and 1280. Sera from three individual monkeys immunized with chimeric DEN-2/1-VP had reciprocal PRNT$_{50}$ titers of 160, 160 and 640. Monkeys injected with diluent as a control for the experiment had reciprocal PRNT$_{50}$ titers of less than 10, as did all of the monkeys just prior to immunization. The chimeric DEN-2/1-EP and -VP viruses elicited DEN-1 virus-specific neutralizing antibodies in non-human primates.

EXAMPLE 2

Construction Of Chimeric DEN-2/3 Infectious Clones

An in vitro ligation strategy was used for the full genome-length DEN-2/3 infectious clones.

(i) 5'-end DEN-2/3 Intermediate Clones: pD2I/D3-P1-Asc and pD21/D3-E1-Asc

Intermediate DEN-2 clones, pD2I-P and pD2I-E were used to subclone the DEN-3 16562 virus-specific cDNA fragment. The cDNA fragment containing the prM-E genes of wild-type DEN-3 16562 virus was amplified by reverse transcriptase-polymerase chain reaction (RT-PCR) from DEN-3 viral RNA with primers D3-435.Mlu: (5'-TGCTG-GCCACTTAACTACGCGTGATGGAGAGCCGCGCA-3' (SEQ ID NO:33); underlined MluI site followed by DEN-3 virus sequence near the 5' end of the prM gene) and cD3-2394.Ngo: (5'-TGTAATGATGCCGGCCGCGATG-CATGAAAATGA-3' (SEQ ID NO:34); underlined NgoMIV site followed by complementary sequence near the 3' end of the E gene of DEN-3 virus). The MluI site contained a silent mutation for DEN-2 virus at amino acid prM-5-Thr. This position is Ser in DEN-3 virus, but Thr in chimeric DEN-2/3 virus. The NgoMIV site resulted in a Val-to-Ala substitution at E-482 of DEN-2 virus, and an Ile-to-Ala substitution at E-480 of DEN-3 virus. The amplified fragment was cloned into the MluI-NgoMIV sites of the intermediate pD2I-P and pD2I-E clones. A restriction site, AscI, was introduced downstream of the NgoMIV site by site-directed mutagenesis to facilitate in vitro ligation. This unique AscI site was only 16 nts downstream from the NgoMIV site and was excised prior to in vitro ligation of the full-length DEN-2/3 clones. An additional mutagenesis at nt 1970 (A-to-T) which changed amino acid E-345 from His to Leu, was introduced to permit derivation of viable chimeric viruses in LLC-MK$_2$ cells, as explained below. These intermediate chimeric DEN-2/3 clones, pD2I/D3-P-Asc and pD2I/D3-E-Asc, were sequenced to verify the accuracy of the inserted DEN-3 virus-specific cDNA. A silent mutation was incorporated at nt 552 (C-to-T) in both intermediate chimeric clones.

(ii) 3'-End DEN-2 Intermediate Clones: pD2-Pmˆb-Asc, pD2-Emˆb-Asc, and pD2-Vmˆb-Asc Intermediate DEN-2 clones containing the truncated DEN-2 virus-specific cDNA sequence from nt 2203–10723 (3'-end) of DEN-2 16681, PDK53-E, or PDK-53-V virus were obtained by deletion of the 5'end (including T7 promoter sequence and DEN-2 nts 1-2202) of the virus specific cDNA in the full-length clones, pD2-16681-P48, pD2-PDK53-E48, and pD2-PDK53-V48, respectively. An AscI site was also introduced at nt 2358 (22 nts upstream of the NgoMIV site) to facilitate the in vitro ligation. This AscI site was excised prior to performing the in vitro ligation of the full genome-length, chimeric DEN-2/3 infectious clones.

(iii) Full-Length Chimeric DEN-2/3 cDNA: DEN-2/3-PP1, DEN-2/3-EP1, and DEN-2/3-VP1

Three to ten mg of the 5'-end pD2I/D3 and 3'-end D2 intermediate clones were digested by AscI, treated with calf intestine phosphatase (CIP), and then digested with NgoMIV. The excised small AscI-NgoMIV fragments were removed by passing the digested DNA through Qiagen PCR-purification spin columns. The large 5'- and 3'-end, linearized intermediate clones were then ligated together (5':3'=1:3 molar ratio) to obtain full genome-length DEN-2/3-PP1 (pD21/D3-P 1-Asc ligated with pD2-Pmˆb-Asc), DEN-2/3-EP1 (pD2I/D3-E1-Asc ligated with pD2-Emˆb-Asc), and DEN-2/3-VP1 (pD2I/D3-E1-Asc ligated with pD2-Vmˆb-Asc). These ligated DNAs were then cut with XbaI to produce the linearized 3'-end of the viral cDNA required for transcription of the recombinant viral RNA.

Recovery of Chimeric DEN-2/3 Viruses

Recombinant viral RNA was transcribed from XbaI-linearized cDNA and capped with the cap analog m$^7$GpppA. LLC-MK$_2$ or BHK-21 cells (3–5×10$^6$ cells) were transfected by electroporation as described by Kinney et al. (*J. Virol* 230: 300–308 (1997)). Transfected cells were transferred to 75-cm$^2$ flasks in DMEM medium containing 10% FBS. Viral proteins expressed in the transfected cells were analyzed by indirect immunofluorescence assay (IFA). Virus-infected cells were fixed in ice-cold acetone for 30 min. DEN-3 and DEN-2 virus-specific monoclonal antibodies 8A1 and 3H5, respectively, were used in the assay, and binding was detected with fluorescein-labeled goat anti-mouse antibody. Viruses were harvested after 5 to 11 days, and were then passaged in LLC-MK$_2$ cells once to obtain working seeds. Viral genomes extracted from these seeds were sequenced to confirm the genotypes of the progeny viruses. An earlier strategy using 5'-end D2I/D3 intermediate clones containing authentic DEN-3 16562 prM-E genes resulted in mutations at several different positions in the genomes of the viruses recovered from transfected LLC-MK$_2$ or BHK-21 cells and passaged once in LLC-MK$_2$ cells. A mutation at nt 1970 from A to T, which changed amino acid E-345 from His to Leu, was found in seven of nine independently recovered recombinant viruses. It was obvious that the original DEN-2/3 chimeric viruses were unstable in LLC-MK$_2$ and/or BHK-21 cells. The single mutation at E-345 was the only mutation that occurred in the genomes of three recovered viruses, indicating that this mutation might help to stabilize the viruses in culture. We introduced this mutation in all the infectious DEN-2/3 clones and recombinant viruses recovered from such mutagenized clones proved to be stable in cell culture.

EXAMPLE 3

Construction Of Chimeric DEN-2/4 Infectious Clones pD2-16681-P48, pD2-PDK53-E48, pD2-PDK53-V48 Vectors The three DEN-2 backbone vectors used for construction of the chimeric DEN-2/4 clones were modified as described above. The DEN-2 infectious clones have been previously reported in Kinney et al., 1997. Clone pD2-16681-P48 was modified from pD2/IC-30P-A to contain cloning sites MluI and NgoMIV at nucleotide positions 451 and 2380, respectively. The same cloning sites were introduced into both DEN-2 PDK-53 virus-specific clones, pD2/IC-130Vx-4 and -130Vc-K, and the modified clones were designated as pD2-PDK53-E48 and pD2-PDK53-V48, respectively. Two cloning errors were found in the original pD2/IC-130Vx-4 and -130Vc-K at nt-6665 and nt-8840. These defects were corrected in pD2-PDK53-E48 and -V48. The introduced NgoMIV cloning site resulted in two nucleotide mutations (nt 2381 and 2382; TG to CC), which encoded a Val-to-Ala substitution at E-482 of DEN-2 virus. The nucleotide changes introduced at the MluI site were silent for DEN-2 virus and chimeric DEN-2/4 viruses. The MluI site (near the C/prM junction) and NgoMIV site (close to E/NS1 junction) were used to clone the prM-E genes of heterologous viruses.

Chimeric pDEN-2/4-PP1, -EP1, and -VP1

Two intermediate DEN-2 clones, pD2I-P and pD2I-E, were constructed by deleting the HpaI (nt-2676) to XbaI (3' terminus of viral genomic cDNA) fragments of pD2-16681-P48 and pD2-PDK53-E48, respectively. These intermediate clones were used to subclone DEN-4 1036 virus-specific cDNA fragments. The cDNA fragment containing the prM-E genes of DEN-4 1036 virus was amplified by reverse transcriptase-polymerase chain reaction (RT-PCR) from DEN-4 viral RNA with primers D4-453Mlu: (5'-GGCGTTTCACTTGTCAACGCGTGATGGC-GAACCCCTCA-3' (SEQ ID NO:35); underlined MluI site followed by sequence near the 5' end of the DEN-4 1036 viral genome) and cD4-2394.Ngo: (5'-AGTGATTCCGC-CGGCAGCTATGCACGTCATAGCCAT-3' (SEQ ID NO:36); underlined NgoMIV site followed by complementary sequence near the 3' end of the E gene of DEN-4 virus). Amplified fragments were cloned into the MluI-NgoMIV sites of the intermediate pD2I-P and pD2I-E clones. Intermediate, chimeric DEN-2/4 clones were sequenced to verify the accuracy of the inserted DEN-4 virus-specific cDNA. A silent mutation was incorporated at nt 1401 (A-to-G) in both intermediate clones. Fragments excised from the DEN-2/IC-P48, -VE48, and -VV48 clones with NgoMIV and ScaI (downstream of DEN-2 cDNA sequence in these plasmids) were cloned into NgoMIV/ScaI-cut chimeric D2/4 intermediate clones to obtain the full-length chimeric D2/4-PP, -EP, and -VP clones. However, transcribed RNA from these chimeric clones only produced viable DEN-2/4 chimeric viruses in transfected C6/36 cells, but not in transfected LLC-MK$_2$ cells. After passaging the chimeric viruses in C6/36 cells one more time to obtain higher titers, these viruses were passaged in LLC-MK$_2$ cells five times to obtain stable chimeric DEN-2/4 viruses which replicated efficiently in LLC-MK$_2$ cells. Titers of the virus seeds increased from 200 PFU/ml at the first LLC-MK$_2$ cell passage to over $10^6$ PFU/ml at the fifth LLC-MK$_2$ cell passage.

The genomes of viruses from the first, second, third and fifth LLC-MK$_2$ cell passages of the chimeric DEN-2/4-PP viruses were sequenced. Four mutations, DEN-2 virus-specific, C-100 (Arg-to-Ser), DEN-4 virus-specific E-364 (Ala- to-Ala/Val mix), DEN-4 virus-specific E-447 (Met-to-Leu) and DEN-2 virus-specific NS4B-239 (Ile-to-Leu) were identified (amino acid positions based on chimeric DEN-2/4 virus sequences). The three mutations located in the structural genes (C and E) were introduced into the chimeric DEN-2/4-PP, -EP, and -VP infectious cDNA clones to obtain DEN-2/4-PP1, -EP1, and -VP1 clones, respectively. All three of these chimeric DEN-2/4 clones produced viable, high-titered chimeric viruses in LLC-MK$_2$ cells immediately after transfection indicating that these three mutations helped the viruses to replicate in LLC-MK$_2$ cells. Chimeric DEN-2/4 clones were also mutagenized to contain different combinations of the four mutations to determine which mutations are needed for replication efficiency of the chimeric DEN-2/4 viruses in LLC-MK$_2$ cells. The DEN-4 E-447 (Met-to-Leu) mutation alone or together with the DEN-4 E-364 mutation, in combination with the DEN-2 C-100 (Arg-to-Ser) mutation was adequate to allow derivation of DEN-2/4 virus in LLC-MK$_2$ cells.

Recovery of Recombinant Viruses.

Recombinant plasmids pD2/4-PP1, -EP1, and -VP1 all were grown in *Escherichia coli* XLI-Blue cells. Recombinant viral RNA was transcribed and capped with the cap analog m$^7$GpppA from 200–400 ng of XbaI-linearized cDNA, and transfected into 3–5.10$^6$ LLC-MK$_2$ cells. Transfected cells were transferred to 75-cm$^2$ flasks in DMEM medium containing 10% FBS. Viral proteins expressed in the transfected cells were analyzed by indirect immunofluorescence assay (IFA). Virus-infected cells were fixed in ice-cold acetone for 30 min. DEN-4 and DEN-2 virus-specific monoclonal antibodies 1H10 and 3H5, respectively, were used in the assay, and binding was detected with fluorescein-labeled goat anti-mouse antibody. Viruses were harvested after 8 to 10 days, and were then passaged in LLC-MK$_2$ cells once to obtain working seeds. The genomes of all these three working seeds were fully sequenced, and all the chimeric DEN-2/4 viral genomes contained the expected sequences. The nucleotide and amino acid sequences for the DEN 2/4 chimera are provided herein at SEQ ID NO:13 and SEQ ID NO:14, respectively.

EXAMPLE 4

Characterization of DEN-213 and DEN-2/4 Chimeric Viruses

The viable, infectious chimeric DEN-2/3 and DEN-2/4 viruses, which express the prM/E gene region of wild-type DEN-3 16562 or wild-type DEN-4 1036 virus, respectively, expressed appropriate DEN-3 or DEN-4 virus-specific envelope protein (E) epitopes, as analyzed by indirect immunofluorescence of virus-infected LLC-MK$_2$ cells with virus-specific anti-E monoclonal antibodies. These chimeric viruses, as well as chimeric DEN-2/1 virus, also expressed appropriate DEN serotype-specific neutralization epitopes when tested against standard polyvalent mouse ascitic fluids or monoclonal antibodies in serum dilution-plaque reduction neutralization tests (Table 8). The chimeric DEN-2/1-EP, DEN-2/3-EP1, and DEN-2/4-EP1 viruses were neutralized by these standard DEN virus-specific antibodies to reciprocal PRNT$_{50}$ titers that were at least as high as those that occurred for wild-type DEN-1, DEN-3, and DEN-4 viruses, respectively (Table 8). These neutralization data indicated that the chimeric DEN-2/1, DEN-2/3, and DEN-2/4 viruses expressed appropriate DEN serotype-specific neutralization epitopes of DEN-1, DEN-3, and DEN-4 viruses, respectively.

Replication in LLC-MK2 Cells

The replication and temperature sensitivity of DEN-2/3 chimeras in LLC-MK2 cells was monitored as the replication and temperature sensitivity of DEN-2/1 chimeras was examined in Example 1. The chimeric DEN-2/3-PP1, -EP1, and -VP1 viruses and chimeric DEN-2/4-PP1, -EP1, and -VP1 viruses, which expressed the prM/E gene region of DEN-3 16562 virus or DEN-4 1036 virus in the genetic background of DEN-2 16681 (-PP1), DEN-2 PDK-53-E variant (-EP1), or the DEN-2 PDK-53-V variant (-VP1), respectively, all replicated to high peak titers of at least $10^{6.3}$ PFU/ml in LLC-MK$_2$ cells. As defined in terms of the reduction of virus titers at 38.7° C. versus those at 37° C. (−, +, 2+, 3+ indicate titer reduction of less than or equal to 60%, 61–90%, 91–99%, >99%, respectively, calculated from at least 3 experiments). Chimeric DEN-2/3-PP1 and DEN-2/4-PP1 viruses exhibited either borderline temperature sensitivity (DEN-2/3-PP1) or no temperature sensitivity (DEN-2/4-PP1). The chimeric DEN-2/3-EP1 and -VP1, as well as the chimeric DEN-2/4-EP1 and -VP1 viruses, all of which were constructed in the genetic background of the DEN-2 PD-53-E or -V variant, retained the temperature-sensitive phenotypes that were exhibited by the two PDK-53 variant viruses (DEN-2-PDK53-E48 and -V48 viruses, respectively). The chimeras constructed in the background of the PDK-53-V variant exhibited a higher degree of temperature sensitivity than did those constructed in the background of the PDK-53-E variant.

Plaque Sizes in LLC-MK2 Cells

The plaque size resulting from inoculation of LLC-MK2 cells placed under agarose overlay, used as a biological marker to determine attenuation as described in Example 1, was also examined for the chimeric DEN-2/3 and DEN-2/4 viruses. Average plaque size in mm follows each virus or chimera in brackets: DEN-3-16562 (6.6), DEN-2/3-PP1 (5.4), DEN-2/3-EP1 (4.5), DEN-2/3-VP1 (2.3), DEN-4-1036 (8.6), DEN-2/4-PP1 (3), DEN-2/4-EP1 (1.5), DEN-2/4-VP1 (1.2), DEN-2-16681-P48 (4.2), DEN-2-PDK53-E48 (2.5) and DEN-2-PDK-53-V48 (1.8).

The plaque sizes of the DEN-2/3-PP1 and DEN-2/4-PP1 viruses exhibited mean plaque diameters that were larger than those of the DEN-2 16681 or PDK-53 virus (as described in Example 1), but smaller than those of wild-type DEN-3 16562 and DEN-4 1036 viruses, respectively. This indicates that structural genes from the donor DEN-3 and DEN-4 viruses and capsid and/or nonstructural gene regions in the recipient genetic background of DEN-2 16681 virus both affected plaque size. The chimeric DEN-2/3-EP1 and -VP1 and DEN-2/4-EP1 and -VP1 viruses exhibited significant reductions in plaque size, relative to wild-type DEN-3 16562 and DEN-4 1036 viruses, respectively. The DEN-2 PDK-53 background-specific effect on plaque size may result from synergistic interaction of the mutations at the NS I-53 and NS3-250 loci of DEN-2 PDK-53 virus. Consequently, -VP1 chimeras exhibited greater reductions in plaque size than did the -EP1 chimeras. The chimeric DEN-2/1, DEN-2/3, and DEN-2/4 viruses constructed in the genetic background of the candidate DEN-2 PDK-53 vaccine virus retained the phenotype of decreased plaque size as exhibited by DEN-2 PDK-53 virus.

Replication in C6/36 Cells

The ability of the viruses to replicate in mosquito C6/36 cell culture, used as a biological marker to determine attenuation as described in Example 1, was also examined for the chimeric DEN-2/3 and DEN-2/4 viruses. Average peak titers in units of Log$_{10}$ PFU/ml follow each virus or chimera in brackets; D3-16562 (7.3), DEN-2/3-PP1 (7.6), DEN-2/3-EP1 (5.2), DEN-2/3-VP1 (5.7), D4-1036 (8.7), DEN-2/4-PP1 (7.8), DEN-2/4-EP1 (4.5), DEN-2/4-VP1 (4.4), DEN-2-16681-P48 (8.3), DEN-2-PDK53-E48 (5.4) and DEN-2-PDK-53-V48 (5).

Both of the Mahidol candidate DEN-2 PDK-53 variants exhibit decreased replication efficiency, relative to wild-type DEN-2 16681 virus, in mosquito C6/36 cell culture (DEN-2-PDK-53-E48 and -V48 versus DEN-2-16681-P48 virus). The decreased replication ability in C6/36 cells has been attributed to the mutations at the two 5'-NC-57 and NS1-53 loci in the DEN-2 PDK-53 virus; consistent with this view, both variants replicated to equivalently reduced peak titers in these cells. This crippled replication phenotype in C6/36 cells was retained in the chimeric DEN-2/3-EP1 and -VP1 and DEN-2/4-EP1 and -VP1 viruses, all of which replicated to lower peak titers than did the wild-type DEN-3 16562 or DEN-4 1036 virus, respectively. The chimeric DEN-2/3-PP1 and DEN-2/4-PP1 viruses, constructed in the genetic background of wild-type DEN-2 16681 virus, replicated to essentially the same extent (DEN-2/3-PP1) as or somewhat lower (DEN-2/4-PP1) than the wild-type DEN-3 16562 and DEN-4 1036 viruses, respectively. These results indicate that the replication-crippling effect of the 5'-NC-57 and NS1-53 loci in the DEN-2 PDK-53 virus-specific background was preserved in those chimeric viruses that were constructed within the DEN-2 PDK-53 genetic background.

Neurovirulence for Newborn Mice

Newborn, outbred, white ICR mice (n=16 for each group) were challenged intracranially with $10^4$ PFU of wild-type DEN-3 and DEN-4 viruses, Mahidol candidate vaccine DEN-3 and DEN-4 viruses, chimeric DEN-2/3-PP1, -EP1, -VP1 viruses, and chimeric DEN-2/4-PP1, -EP1, and -VP1 viruses (Table 9). The wild-type DEN-3 16562 and DEN-4 1036 viruses, which reliably caused 100% fatality in newborn mice, constituted a more sensitive model for attenuation of viral neurovirulence than does the DEN-2 16681 challenge model, which results in 50–100% fatality in newborn mice challenged with this virus. Interestingly, the Mahidol candidate DEN-4 PDK-48 vaccine virus also resulted in 100% fatality in challenged mice, although the average survival time of these mice was about two days longer than for mice challenged intracranially with wild-type DEN-4 1036 virus (Table 9). Like the DEN-2 PDK-53 vaccine virus and both of its variant populations, the chimeric DEN-2/3-EP1 and -VP1 and chimeric DEN-2/4-EP1 and -VP1 viruses were attenuated (no fatalities) for newborn mice. This attenuation may be attributable, at least in part, to the attenuated DEN-2 PDK-53 genetic background of these chimeric viruses, because the chimeric DEN-2/4-PP1 virus exhibited significant neurovirulence (62.5% mortality) in these mice. This latter chimera was constructed in the genetic background of wild-type DEN-2 16681 virus.

Immunization of AG-129 Mice with Chimeric DEN-2/3 and DEN-2/4 Viruses

Inbred AG-129 mice were immunized intraperitoneally with $10^5$ PFU of wild-type or Mahidol vaccine candidate DEN-3 or DEN-4 virus or with $10^5$ PFU of chimeric DEN-2/3-EP1 or DEN-2/4-EP1 virus (Table 10). The chimeric DEN-2/3-EP1 virus elicited reciprocal $PRNT_{70}$ titers of 80–320 at 4–6 weeks after primary immunization. These titers were essentially equivalent to those elicited by the Mahidol DEN-3 vaccine virus (strain PGMK-30/FRhL-3). However, the chimeric DEN-2/4-EP1 virus elicited neutralizing antibody titer of 20–40, which was lower than the 80–320 titer elicited by the Mahidol vaccine candidate DEN-4 PDK-48 vaccine virus. Nevertheless, both chimeric DEN-2/3 and DEN-2/4 viruses elicited neutralizing antibody responses in AG-129 mice.

EXAMPLE 5

Attenuation of a Dengue-2 Vaccine Virus: Strain 16681 (PDK-53)

Viruses and Cell Cultures

The parental DEN-2 16681 virus, several intermediate PDK passages (PDK-5, -10, -14, -35, and -45) of 16681 virus, recombinant 16681/PDK-53 viruses, and the genetically characterized LLC-MK$_2$-1 passage of the candidate PDK-53 vaccine virus were investigated.

Cell cultures of BHK-21 (clone 15), LLC-MK$_2$, Vero, and C6/36 were grown in Dulbecco's modified minimal essential medium (DMEM) supplemented with 10% heat-inactivated (56° C. for 30 min) fetal bovine serum (FBS; HyClone Laboratories, Inc., Logan, Utah), 3.7 g/L of sodium bicarbonate (GIBCO-BRL, Life Technologies, Gaithersburg, Md.), 100 units/ml of penicillin G, and 100 mg/ml of streptomycin sulfate (GIBCO-BRL).

Plaque titrations were performed in confluent monolayers of Vero cells in plastic 6-well plates as described previously (Miller et al., *Am. J. Trop. Med. &Hyg.* 35: 1302–1309 (1986)). A 200-µl inoculum of virus was adsorbed for 1.5 h at 37° C., followed by the addition of 4 ml of agarose overlay medium containing 1% SeaKem LE agarose (FMC BioProducts, Rockland, Md.) in nutrient medium (0.165% lactalbumin hydrolysate [Difco Laboratories, Detroit, Mich.], 0.033% yeast extract [Difco], Earl's balanced salt solution, 25 mg/L of gentamicin sulfate [Bio Whittaker, Walkersville, Md.], 1.0 mg/L of amphotericin B [Fungizone®, E. R. Squibb & Sons, Princeton, N.J.], and 2% FBS). Following incubation at 37° C. for 7 days, a second 2-ml agarose overlay containing 80 µg/ml of neutral red vital stain (GIBCO-BRL) was added.

Construction of Recombinant DEN-2 16681/PDK-53 Viruses

During the genetic validation of clone-derived DEN-2 viruses in the present study, two cDNA cloning errors were discovered, nt-6665 A-to-G (NS4A-97 Tyr-to-Cys) and nt-8840 A-to-G (NS5-424 Glu-to-Gly), in the previously reported PDK-53 virus-specific pD2/IC-130Vc-K (NS3-250-Val variant) clone (Kinney et al., Virology 230: 300–308 (1997)). These defects were corrected in a newly derived PDK-53 virus-specific (NS3-250-Val variant) clone, pD2/IC-VV45R.

In preliminary studies, recombinant 16681/PDK-53 viruses containing PDK-53 virus-specific gene regions within the genetic background of 16681 virus were used to investigate the genetic loci involved in the attenuation markers of PDK-53 virus. Analyses of these viruses indicated that the PDK-53 mutation at nt-57 in the 5'NC region and the amino acid mutations at NS1-53 (analyzed in a linked manner with the NS2A-181 mutation) and NS3-250 were the determinants of the PDK-53 virus-specific phenotype. The prM-29 mutation has little effect on virulence. Based upon sequence analysis and comparison, the 5'NC, NS1 and NS3 mutations were subjected to further mutational analysis. The 5'NC mutation occurred in a possible stem structure. The NS1 and NS3 mutations both occurred at loci conserved in some flaviviruses. 14 recombinant pD2/IC-16681/PDK-53 plasmids were constructed by exchanging cDNA fragments between pD2/IC-30P-A (16681 clone) and pD2/IC-VV45R (PDK-53 clone) at restriction enzyme sites SstI (preceding the T7 promoter), SalI (nt-165), SphI (nt-1380), SpeI (nt-2370 and nt-3579), KpnI (nt-4493), XhoI (nt-5426), and XbaI (3' end of the clone). All recombinant plasmids were grown in *Escherichia coli*, strain XLI-blue, and were linearized at the unique XbaI site engineered at the 3) terminus of the cDNA. BHK-21 cells were transfected with transcribed viral RNA by the method of Liljestrom et al. (*J. Virology* 63: 4107–4113 (1991)).

The genotypes of the recombinant D2/IC-Px (where x=5, 1, and/or 3 to indicate the incorporation of the parental [P in the virus designation] 16681 virus-specific 5'NC-57, NS1-53, and/or NS3-250 loci into the pD2/IC-VV45R [PDK-53] backbone) and D2/IC-Vx (where x indicates the reciprocal incorporation of the three candidate PDK-53 vaccine [V in the virus designation] virus-specific loci within the pD2/IC-30P-A [16681] backbone) viruses are shown in Table 11. If the 5'NC, NS1, and NS3 loci are the primary determinants of the PDK-53 virus-specific phenotype, then the D2/IC-P5 and D2/IC-V13 viruses should be equivalent (cognate) because both viruses contain 5'NC-57-C, NS1-53-Asp, and NS3-250-Val. The cognate virus pairs derived from reciprocal mutagenesis of the 16681 and PDK-53 virus-specific infectious clones are indicated in Table 11. To further investigate the prM-29 locus, we moved the prM-29-Asp locus of DEN-2 16681 virus into pD2/IC-VV45R and pD2/IC-P5 to derive recombinant D2/IC-Pp and -P5p viruses, respectively. Reciprocal recombinations yielded D2/IC-Vp and -V5p viruses.

Each clone-derived virus (transfected BHK-21 seed) was propagated once in LLC-MK$_2$ cells. The genotypes of all of the LLC-MK$_2$-1-passaged, recombinant 16681/PDK-53 viruses were confirmed by complete nucleotide sequence analyses of their genomes. Because all of the viruses had the expected nucleotide sequences, we inferred that their cDNA clones were also correct. All of the clone-derived viruses contained the 16681 virus-specific nt-8571-C locus, which is the site of a silent mutation in PDK-53 virus. Direct sequencing of overlapping cDNA amplicons generated from DEN-2 viral genomic RNA using reverse transcriptase-polymerase chain reaction (RT-PCR) was used to determine the sequence of all but the termini of the cDNA. The sequences of the 5'- and 3'-terminal 30 nucleotides of the genome were determined by direct sequencing of the infectious clone cDNA in plasmid pBRUC-139. The D2/IC-prefix is eliminated in the virus designations in Table 11 and the following text.

Characterization of the Replication Phenotypes of Recombinant 16681/PDK-53 Viruses.

Viruses were analyzed for plaque size, temperature sensitivity, and replication in LLC-MK$_2$ and C6/36 cells. Plaque sizes were evaluated after 9 days of incubation under agarose in LLC-MK$_2$ cell monolayers grown in 6-well plates. Viral growth curves were performed in 75-cm$^2$ flasks of LLC-MK$_2$ or C6/36 cells inoculated at multiplicity of infection (m.o.i.) of approximately 0.001 PFU/cell. After adsorption at 37° C. for 2 h, 30 ml of DMEM medium (LLC-MK$_2$ cells) or overlay nutrient medium (C6/36 cells) containing penicillin/streptomycin and 5% FBS was added, and the cultures were incubated in 5% CO$_2$ at 37° C. or 29° C., respectively. Aliquots of culture medium were removed at 48-h intervals, adjusted to 12.5% FBS, and stored at −80° C. prior to virus titration.

Temperature sensitivity assays were performed in LLC-MK$_2$ cells grown in 75-cm$^2$ flasks. The cells were inoculated at a m.o.i. of about 0.001 PFU/cell. After adsorption for 2 h at 37° C., 30 ml of DMEM medium containing 5% FBS was added. One set of cultures was incubated for 8 days at 37° C., the other at 38.7° C. The ratio of virus titer at 38.7° C. versus the titer at 37° C. was calculated.

Mouse Neurovirulence Assay

Litters of newborn, outbred white ICR mice were inoculated intracranially with 10$^4$ PFU of virus in a volume of 30 ml. Mice were individually weighed once a week and were observed for paralysis or death for 35 days.

Plague Phenotypes of Recombinant 16681/PDK-53 Viruses

Figure 4A:
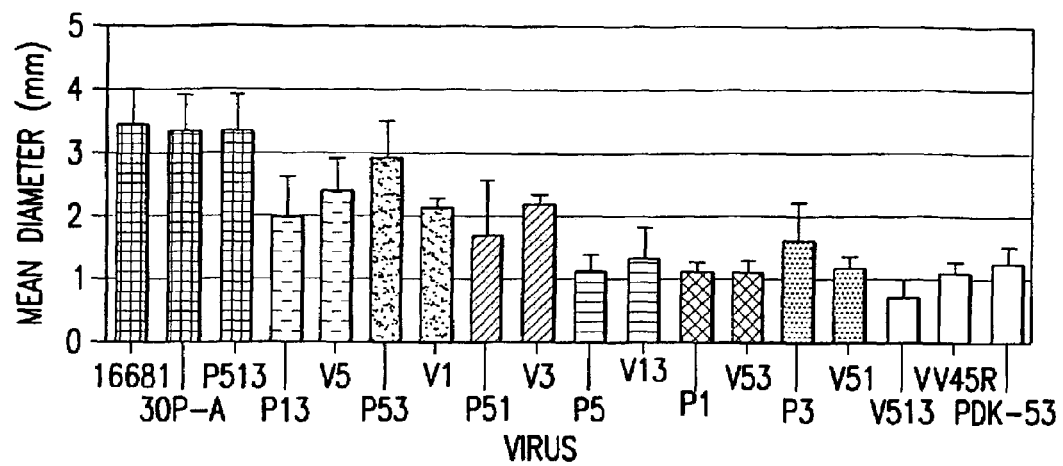
FIGS. 4A–C.
Figure 4B:
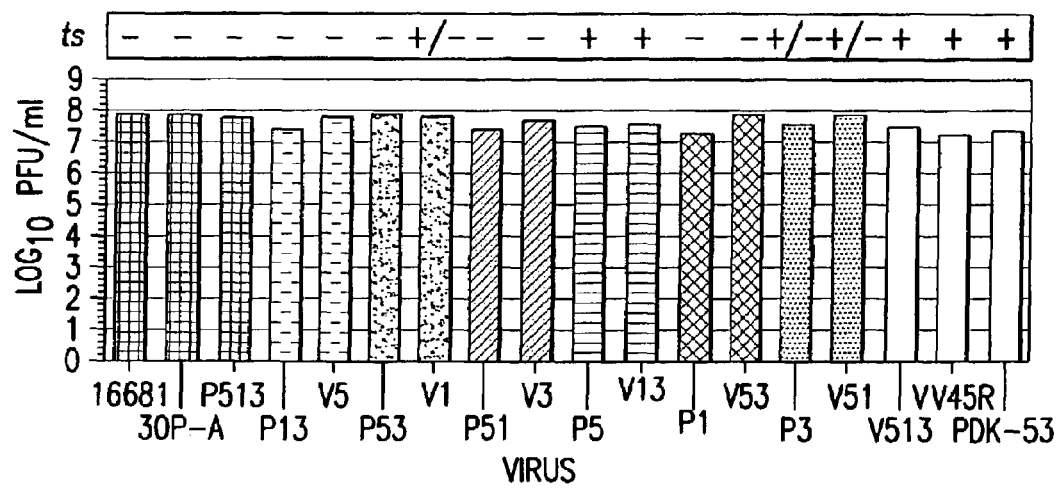
Figure 4C:
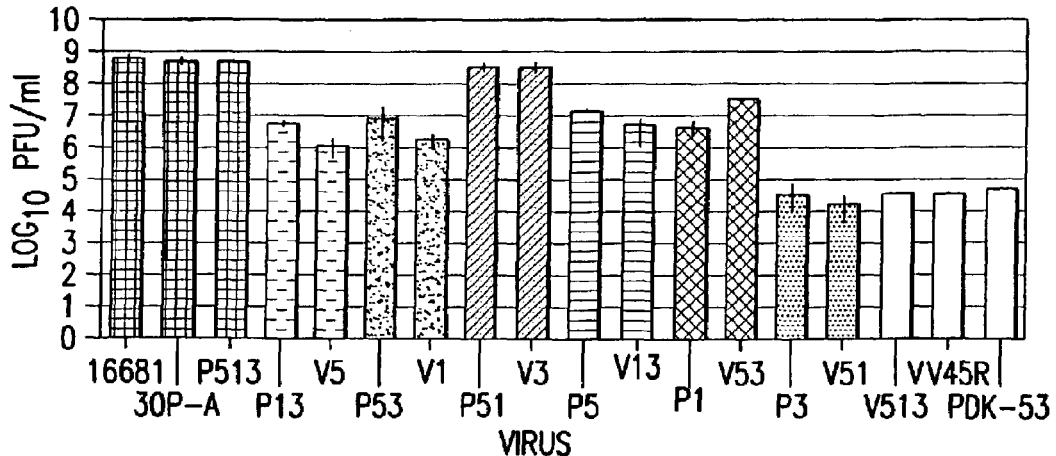

Mean diameters of virus plaques (n=12) at 9 days after infection under agarose overlay in LLC-MK$_2$ cells were measured (FIG. 4). The largest plaques (3.2–3.4 mean diameter) were produced by the wild-type 16681 virus, its clone-derived 30P-A virus, and the recombinant P513 virus, which contained the 5'NC, NS1, and NS3 16681 virus-specific loci in the VV45R (PDK-53) virus genetic background (Table 1). These three 16681-specific loci within the PDK-53 genetic background were sufficient to reconstitute the large plaque phenotype of the 16681 virus.

Individual PDK-53 virus-specific 5'-NC-57-T, NS1-53-Asp, and NS3-250-Val mutations incorporated into the 16681 genotype each resulted in significantly ($p<0.00003$) decreased plaque sizes of 2.1–2.3 mm in V5, V1, and V3 viruses, respectively, versus those of 16681 virus. The plaque phenotypes of P13 and P51 viruses were similar to those of their cognate V5 and V3 viruses (indicated by graph bars with identical solid or cross-hatching pattern in FIG. 4). The 2.8-mm plaque size of P53 virus differed from 16681 viral plaques to a lesser degree ($p<0.03$) than did the 2.1-mm plaques of its cognate V1 virus. The 1.1–1.6-mm plaques of cognate virus pairs V13 (P5) (containing PDK-53 virus-specific NS1 and NS3 loci), V53 (P1) (PDK-53 virus-specific 5'NC and NS3 loci), and V51 (P3) virus (PDK-53 virus-specific 5'NC and NS1 loci) were essentially equivalent to the 1.3-mm plaques of PDK-53 virus. These results indicate that all pairwise combinations of these three PDK-53 virus-specific loci in the 16681 backbone generated a small-plaque virus similar to PDK-53 virus. Although V51 virus produced a plaque phenotype that was similar to that of PDK-53 virus, all three 16681 virus-specific 5'NC-C, NS1-53-Gly, and NS3-250-Glu loci were required within the PDK-53 background of P513 virus to reconstitute the plaque phenotype of 16681 virus. The presence of all three PDK-53 loci in the 16681 backbone generated V513 virus, which had a smaller ($p<0.001$, Student's t test) plaque phenotype than that of either PDK-53 or VV45R virus. The difference between the plaque size of PDK-53 virus and that of VV45R virus was not significant.

Recombinant Vp virus, which contained the PDK-53 virus-specific prM-29-Val locus in the 16681 background, had a significantly ($p<0.002$) reduced plaque size of 2.6 mm. However, the 1.0-mm plaque phenotype of Pp virus (16681 prM-29-Asp locus in the PDK-53 background) was essentially identical to the 1. I-mm and 1.3-mm plaques of VV45R and PDK-53 viruses (FIG. 4A), respectively. The prM-29 locus did not affect the plaque phenotypes of P5p (1.0±0.0 mm) and V5p (2.0±0.4 mm) viruses, which produced plaques similar to those of P5 (1.1±0.3 mm) and V5 (2.3±0.4 mm), respectively.

Replication of Recombinant 16681/PDK-53 Viruses in LLC-$MK_2$ and C6/36 Cells

All of the viruses replicated well in LLC-$MK_2$ cells, reaching peak titers of $10^{7.3}$–$10^{7.9}$ PFU/ml at 6–8 days after infection. PDK-53 and its clone-derived VV45R virus replicated at a reduced rate during the first four days after infection, relative to the other viruses. To determine temperature sensitivities, virus-infected LLC-$MK_2$ cells were incubated at 37° C. or 38.7° C. in 2–5 experiments (FIG. 4B). Temperature sensitivity scores were determined at 8 days after infection. All of the viruses exhibited some degree of temperature sensitivity under these conditions. In individual experiments, wild-type 16681 virus showed 75–80% titer reduction at 38.7° C. Virus V1 and cognate viruses P3 (V51), which showed 84–86% average reductions in titer, were slightly more temperature-sensitive than 16681 virus. However, only PDK-53, VV45R, V513, P5p, Pp, and the cognate recombinant viruses V13 and P5, all of which contained both the NS1-53-Asp and NS3-250-Val PDK-53 virus-specific loci, reproducibly showed 90–97% average reduction in titer at 38.7° C.

The 16681 virus and its clone-derived 30P-A virus replicated to average peak titers of $10^{8.6}$–$10^{8.8}$ PFU/ml at 12 days after infection in two independent growth-curve experiments in C6/36 cells (FIG. 4C). The replication of PDK-53 virus (peak titer of $10^{4.5}$ PFU/ml) and its clone-derived VV45R (peak titer of $10^{4.6}$ PFU/ml) virus was approximately 15,000-fold less efficient in C6/36 cells. The 16681 virus-specific 5'NC and NS1 loci within the PDK-53 background of P51 virus fully reconstituted the replication efficacy to that of wild-type 16681 virus. Conversely, the PDK-53 virus-specific 5'NC and NS1 loci within the 16681 background of V51 virus were sufficient to establish the crippled replication phenotype of PDK-53 virus. Recombinant cognate virus pairs V5 (P13) and V1 (P53), which contained the PDK-53 virus-specific 5'NC region or NS1 locus, respectively, replicated to average peak titers of $10^{5.9}$–$10^{6.7}$ PFU/ml. Although the average peak titer of V53 virus was about 40-fold greater than that of V5 virus in C6/36 cells, the peak titers of P513, P13, P53, V3, V13, V513, and P3 viruses were very similar to those of P51, P1, P5, 30P-A, V1, V51, and VV45R viruses, respectively. These data indicated that the NS3-250 locus had little or no observable effect on replication in C6/36 cells (FIG. 4C). Vp and 16681 viruses had nearly equal average peak titers in C6/36 cells, as did P5 and P5p viruses. Pp and V5p viruses produced average peak titers that were slightly higher (8- and 40-fold, respectively) than those of PDK-53 and V5 viruses, respectively. The prM-29 locus appeared to have little or no effect on viral replication in C6/36 cells.

Neurovirulence of Recombinant 16681/PDK-53 Viruses in Newborn Mice

To investigate the neurovirulence of the recombinant viruses, two litters of newborn white ICR mice, eight mice per litter, were infected intracranially with $10^4$ PFU of virus. The DEN-2 16681 virus and its clone-derived 30P-A virus cause 50%–100% mortality in these mice. Average survival times (AST) for mice succumbing to challenge with 16681 or 30P-A virus ranged from 15.2 to 16.8 days in various experiments. Mice were weighed individually every 7 days after infection. A single mouse died by day 1 after infection, presumably as a result of inoculation trauma, in each of the P53 and Vp groups (Table 12). These two mice were excluded from the analyses. There were no fatalities and no weight loss in the control, diluent-inoculated group.

Three mouse neurovirulence phenotypes were observed (Table 12). The first phenotype consisted of the mouse-virulent viruses DEN-2 16681, 30P-A, P513, P51, V3, and Vp, which caused at least 50% mortality with AST of 13.2–17.0 days (Table 12). In two other independent experiments, the Vp virus caused 46.67% mortality with AST of 17.4±1.4 days (n=16) and 56.25% mortality with AST of 18.3±1.3 days (n=16). In an independent experiment, P51 virus caused only 25% mortality with AST of 15.9±5.5 days (n=16). A second phenotype consisted of the mouse-attenuated PDK-53, VV45R, V513, Pp, and cognate V51 (P3) viruses, which caused no mortality, and the nearly attenuated V1, cognate V13 (P5), P5p, and V5p viruses, which killed only 1 of 16 mice (Table 12). The presence of the two PDK-53 virus-specific 5'NC-57-T and NS1-53-Asp loci within the 16681 genetic background was sufficient to result in or maintain attenuation in cognate viruses V51 (P3). Except for P53 virus, all of the viruses containing the PDK-53 virus-specific NS1-53-Asp locus were attenuated or nearly attenuated.

The third phenotype, that of intermediate virulence, characterized cognate virus pairs V5 (P13) and V53 (P1), and P53 virus which caused 18.75–37.5% mouse mortality and significant weight loss (p<0.001, Student's t test, at 3 weeks after infection, relative to diluent-inoculated control mice) in mice that survived virus challenge. Viruses V5 (P13) and V53 (P1) contained the 5'NC-57-T, but not the NS1-53-Asp, locus of PDK-53 virus. V1 virus (6.25% mortality) was more attenuated than V5 virus, which produced 18.75% mortality and significant weight loss in the survivors. Conversely, the 16681 virus-specific 5'-NC-57-C locus caused little reversion to virulence in P5 virus (6.25% mortality), whereas the NS1-53-Gly moiety in P1 virus resulted in an intermediate level (37.5%) of mortality and significant weight loss in the survivors. Unlike the nearly attenuated cognate V1 virus, P53 virus had an intermediate virulence phenotype. The NS1-53 locus had a more significant effect on the virulence phenotype than did the 5'-NC-57 locus.

The prM-29 locus showed no effect in P5p, Pp, and Vp viruses, relative to P5, PDK-53, and 16681 viruses, respectively. The V5p virus, which contained both PDK-53 virus-specific 5'NC-57-T and prM-29-Val loci, was nearly attenuated (Table 2). The NS3-250 locus did not appear to contribute significantly to mouse neurovirulence phenotype in V3, P13, V53, V13, and P3 viruses, which exhibited phenotypes that were equivalent to 16681, P1, V5, V1, and PDK-53 viruses, respectively. The difference in the level of mortality caused by P53 and P5 viruses suggested that the 16681 virus-specific NS3-250-Glu locus might contribute somewhat to the virulence phenotype within certain genetic contexts.

Evolution of Mutations in the DEN-2 PDK-53 Vaccine Virus

Intermediate passages PDK-5, -10, -14, -35, and -45 of the 16681 virus were analyzed to determine the accrual of the nine nucleotide mutations in the PDK-53 vaccine strain. Amplicons were amplified directly from genomic mRNA extracted from the viral seed by RT/PCR. Automated sequencing of small genomic regions, which contained the nine relevant loci, was performed by using appropriate primers. The nucleotide residues identified at each of the nine loci for these viruses are shown in Table 13. The NS2A-181 Leu-to-Phe mutation and the silent mutations at E-37, NS3-342, and NS5-334 appeared by passage PDK-5 and were the predominant moieties by passage PDK-10 (NS2A-181), PDK-14 (E-373, NS3-342), or PDK-35 (NS5-334). Mutations 5'-NC-57 C-to-T, prM-29 Asp-to-Val, NS1-53 Gly-to-Asp, and NS4A-75 Gly-to-Ala occurred by passage PDK-35. The 5'-NC-57-T was predominant at passage PDK-35, while the other listed mutations became predominant by passage PDK-45. The NS3-250 Glu-to-Val mutation appeared by passage PDK-45 and is not fully mutated to the virus-specific Val in the current PDK-53 vaccine candidate (Table 13). Approximately 29% of the viral population in the PDK-53 vaccine contains NS3-250-Glu. The PDK-45 virus was genetically equivalent to the PDK-53 vaccine virus. In the present study, no attempt was made to determine the relative proportions of the two nucleotides at the mixed genetic loci shown in Table 13.

EXAMPLE 6

Construction of Chimeric DEN-2/West Nile Clones and Virus

Genome-length, chimeric DEN-2/WN infectious cDNA clones containing structural genes of WN virus within the genetic background of DEN-2 virus were constructed using the in vitro ligation strategy used to derive the chimeric DEN-2/3 viruses described earlier.

In a first example, the prM-E encoding cDNA of the 5'-end subclone that was used to derive a chimeric DEN-2/3-PP1 virus clone (see Example 2) was replaced with the prM-E gene region of WN virus, strain NY 99 (New York 1999). The cDNA fragment containing the prM-E gene region of WN virus was amplified by reverse transcriptase-polymerase chain reaction (RT-PCR) from WN virus-specific genomic RNA with forward primer WN-M (5'-GGAG-CAGTTACCCTCTCTACGCGTCAAGGGAAGGTGATG-3' (SEQ ID NO:37); underlined MluI-site followed by WN virus sequence near the 5' end of the prM gene) and reverse primer cWN-E (5'-GAAGAGCAGAACTCCGCCGGCT-GCGAGAAACGTGA GAGCTATGG-3'(SEQ ID NO:38); underlined NgoMIV site followed by sequence that was complementary to the WN genomic sequence near the 3' end of the E gene of WN virus). The amplified prM-E cDNA fragment was cloned into the MluI-NgoMIV sites of the intermediate pD2I/D3-P1-AscI clones, exactly as was done during the derivation of chimeric DEN-2/3 virus (see Example 2, construction of chimeric DEN-2/3 infectious clones), to replace the prM/E region of the DEN-3 16562 virus. In this chimeric DEN-2/WN cDNA, the prM splice site encoded the amino acid sequence (shown as single-letter amino acid abbreviations, and written in amino-to-carboxyl order) SAGMIIMLIPTVMA-FHLTTROGKVMMTV (SEQ ID NO:39). The hyphen in this sequence indicates the polyprotein cleavage site located between the capsid and prM genes; the amino-terminal sequence is DEN-2 virus specific; the carboxyl-terminal sequence in bold, underlined, italicized font indicates the WN virus-specific sequence (QGKVMMTV) (SEQ ID NO:40) near the amino terminus of the prM protein encoded by this chimeric construct. This intermediate DEN-2/WN subclone was ligated in vitro with the 3'-end intermediate DEN-2 subclone, pD2-Pnˆb-Asc, by the same protocol described in example 2 (construction of chimeric DEN-2/3 infectious clones) to produce the full genome-length, chimeric DEN-2/WN viral cDNA that was used to transcribe chimeric DEN-2/WN virus-specific genomic RNA. Using the same protocol described in example 2, mammalian LLC-MK$_2$ or mosquito C6/36 cells were transfected with the transcribed chimeric DEN-2/WN RNA. This strategy, which involved using the same MluI restriction enzyme splice site that was used to derive the chimeric DEN-2/3 and DEN-2/4 viruses, failed to produce viable chimeric virus after transfection of the transcribed chimeric DEN-2/WN RNA in LLC-MK$_2$ cells, and resulted in only very low titers (<100 PFU/ml) in C6/36 cells. This failure is probably due to significant gene sequence variation between the carboxyl-terminal ends of the viral capsid proteins and between the amino-terminal ends of the prM protein of DEN-2 and WN viruses. The carboxyl-terminal region of the flavivirus capsid protein serves as a signal peptide sequence for the insertion of prM into intracellular membranes (endoplasmic reticulum) during maturation and cleavage of the prM protein. This DEN-2/WN construct, which contained the capsid-carboxyl-terminal signal sequence, as well as the amino-terminal residues of the prM protein of the DEN-2 backbone, apparently did not permit appropriate maturation of the chimeric virus.

In a second example, the chimeric DEN-2/WN cDNA clone was modified so as to encode the carboxyl-terminal region of the capsid protein, as well as the entire prM protein and most of the E protein, of WN virus. A unique SstII restriction site was introduced by site-directed mutagenesis near the 3' terminus of the DEN-2 virus-specific capsid gene to serve as a new 5' splice site for the WN capsid-carboxyl-end/prM/E gene region. This SstII site introduced two silent mutations in the DEN-2 virus-specific sequence encoding the amino acid triad SAG (single-letter abbreviations). The appropriate gene region was amplified from WN viral RNA by using the forward primer WN-452.5AG (5'-AAT-TCAACGCGTACATCCGCGGGCACCG-GAATTGCAGTCA TGATTGGCCTGATGGC-3' (SEQ ID NO:41); underlined SstII site followed by WN virus-specific sequence) and the same reverse cWN-E primer that was utilized in the previous construct (as described above). This amplified cDNA was cloned to make the intermediate subclone pDEN-2/WN-P-SA which contained cDNA encoding the 5' noncoding region and most of the capsid gene from DEN-2 16681 virus and the carboxyl-terminal capsid, entire prM, and most of the E gene from WN virus, as well as a unique AscI site downstream of the NgoMIV site. In this chimeric DEN-2/WN cDNA, the prM splice site encoded the amino acid sequence (shown as single-letter amino acid abbreviations, and written in amino-to-carboxyl order) SAGTGIAVMIGLIASVGA-VTLSNFOGKVMMTV (SEQ ID NO:42). The hyphen in this sequence indicates the polyprotein cleavage site located between the capsid and prM genes; the amino-terminal sequence is DEN-2 virus specific; the carboxyl-terminal sequence in bold, underlined, italicized font indicates the WN virus-specific sequence (TGIAVMIGLIASVGA-VTLSNFQGKVMMTV) (SEQ ID NO:43) encoded by this chimeric construct. Following the in vitro ligation protocol of the chimeric DEN-2/3 clones described for chimeric DEN-2/3 virus in example 2, the 5'-end intermediate subclone pDEN-2/WN-P-SA was ligated to the 3'-end pD2-Pmˆb-Asc subclone to produce the full genome-length cDNA of the chimeric DEN-2/WN-PP1 virus for transcription of the chimeric RNA. The chimeric DEN-2/WN-PP1 construct encoded the indicated WN structural gene region within the genetic background of the wild-type DEN-2 16681 virus. Both LLC-MK$_2$ and C6/36 cells were transfected with RNA transcribed from this in vitro-ligated, chimeric DEN-2/WN-PP1 clone. Viable, chimeric DEN-2/WN-PP1 virus, at virus titers of $10^3$–$10^6$ PFU/ml of culture medium, was successfully recovered from both transfected cell cultures. Nucleotide sequence analysis of the entire genome of the clone-derived, chimeric DEN-2/WN virus demonstrated the expected genomic sequence. These results demonstrate that the DEN-2 infectious clones of the invention can be used to construct chimeric viruses that express structural genes of heterologous flaviviruses other than DEN-1, DEN-3, and DEN-4 viruses.

All of the patents, publications and other references mentioned herein are hereby incorporated in their entirety by reference. Modifications and variations of the present methods and compositions will be obvious to those skilled in the art from the foregoing detailed description. Such modifications and variations are intended to come within the scope of the appended claims.

TABLE 1

Viral Candidates for Flavivirus Chimeras[+]

Primary Mosquito-Borne Species

Dengue-1 **
Dengue-3 **
Dengue-4 **
Yellow fever **
Japanese encephalitis **
Murray Valley encephalitis **
St. Louis encephalitis **
West Nile **
Kunjin *
Tick-Borne:

Absettarov **
Gadgets Gully
Hanzalova **
Hypr**
Kadam
Karshi
Kumlinge **
Kyasanur Forest disease **
Langat
Louping ill **
Meaban
Omsk hemorrhagic fever **
Powassan **
Royal Farm
Russian spring summer encephalitis **
Saumarez Reef
Tyuleniy
Other Mosquito-Borne: Species Alfuy
Bagaza
Banzi **
Bouboui
Bussuquara **
Edge Hill **
Ilheus
Naranjal
Israel turkey meningitis
Jugra
Kokobera
Ntaya
Rocio **
Sepik **
Spondweni **
Stratford
Tembusu
Uganda S
Usutu **
Wesselsbron* *
Zika **
No Arthropod Vector Demonstrated Apoi *
Aroa
Cacipacore
Carey Island
Cowbone Ridge
Dakarbat **
Entebbe bat
Jutiapa
Koutango *
Modoc *
Montana Myotis leukemia
Negishi **
Phnom-Penh bat
Rio Bravo **
Saboya
Sal Vieja

TABLE 1-continued

Viral Candidates for Flavivirus Chimeras[+]

San Perlita
Sokuluk

* = Laboratory infection reported

** = Natural and laboratory infection reported

[+] = List includes the currently classified members of the *Flavivirus* genus in the International Catalogue of Arboviruses, Including Certain Other Viruses of Vertebrates, Nick Karabatsos, ed. The American Society of Tropical Medicine and Hygiene. 1985.

TABLE 2

Summary Of Nucleotide And Amino Acid Differences Between The Genomes Of DEN-1 16007 Virus And Its Vaccine Derivative, Strain PDK-13

| Genome Nucleotide Position | Nucleotide 16007 | Nucleotide PDK-13 | Amino Acid 16007 | Amino Acid PDK-13 | Protein Position | Polyprotein Position |
|---|---|---|---|---|---|---|
| 1323 | T | C | Val | Ala | E-130 | 410 |
| 1541) | G | A | Glu | Lys | E-203 | 483 |
| 1543) | A | G | | | | |
| 1545 | G | A | Arg | Lys | E-204 | 484 |
| 1567 | A | G | Gln | Gln | E-211 | 491 |
| 1608 | C | T | Ser | Leu | E-225 | 505 |
| 2363 | A | G | Met | Val | E-477 | 757 |
| 2695 | T | C | Asp | Asp | NS1-92 | 867 |
| 2782 | C | T | Ala | Ala | NS1-121 | 896 |
| 5063 | G | A | Glu | Lys | NS3-182 | 1657 |
| 6048 | A | T | Tyr | Phe | NS3-510 | 1985 |
| 6806 | A | G | Met | Val | NS4A-144 | 2238 |
| 7330 | A | C | Gln | Gln | NS4B-168 | 2412 |
| 9445 | C | T | Ser | Ser | NS5-624 | 3117 |

TABLE 3

Summary Of Nucleotide And Amino Acid Sequence Differences Between The Genomes Of DEN-2 16681 Virus And Its Vaccine Derivative, Strain PDK-53

| Genome Nucleotide Position | Nucleotide 16681 | Nucleotide PDK-53 | Amino Acid 16681 | Amino Acid PDK-53 | Protein Position | Polyprotein Position |
|---|---|---|---|---|---|---|
| 57 | C | T[a] | — | — | | |
| 524 | A | T | Asp | Val | prM-29 | |
| 2055 | C | T | Phe | Phe | E-373 | 653 |
| 2579 | G | A | Gly | Asp | NS1-53 | 828 |
| 4018 | C | T | Leu | Phe | NS2A-181 | 1308 |
| 5270 | A | T/A | Glu | Glu/Val[b] | NS3-250 | 1725 |
| 5547 | T | C | Arg | Arg | NS3-342 | 1817 |
| 6599 | G | C | Gly | Ala | NS4A-75 | 2168 |
| 8571 | C | T | Val | Val | NS5-334 | 2825 |

[a]5' noncoding region.
[b]The PDK-53 vaccine contains two genetic variants at nt-5270.

TABLE 4

Summary Of Nucleotide And Amino Acid Differences Between The Genomes Of DEN-3 16562 Virus And Its Vaccine Derivative, Strain PGMK-30/Frhl-3

| Genome Nucleotide Position | Nucleotide 16562 | PGMK-30 FRhL-3 | Amino Acid 16562 | PGMK-30/ FRhL-3 | Protein Position | Polyprotein Position |
|---|---|---|---|---|---|---|
| 550 | C | T | Ala | Ala | prM-38 | 152 |
| 1521 | C/T | C | Ser/Leu[a] | Ser | E-196 | 476 |
| 1813 | G | A | Lys | Lys | E-293 | 573 |
| 1838 | A | G | Ser | Gly | E-302 | 582 |
| 1913 | G | A | Glu | Lys | E-327 | 617 |
| 2140 | C | T | Ala | Ala | E-402 | 682 |
| 3725 | T | C | Phe | Leu | NS2A-86 | 1211 |
| 4781 | C | A | Gln | Lys | NS3-90 | 1563 |

[a]Two significant genetic variants were located at nt-1521.

TABLE 5

Summary Of Nucleotide And Amino Acid Differences Between The Genomes Of DEN-4 1036 Virus And Its Vaccine Derivative, Strain PDK-48

| Genome Nucleotide Position | Nucleotide 1036 | PDK-48 | Amino Acid 1036 | PDK-48 | Protein Position | Polyprotein Position |
|---|---|---|---|---|---|---|
| 1211 | T | C | Ile | Ile | E-91 | 370 |
| 1971 | G | A | Glu | Lys | E-345 | 624 |
| 3182 | G | C | Gln | His | NS1-253 | 1027 |
| 6660 | C | T | Leu | Phe | NS4A-95 | 2187 |
| 6957 | A | A/T | Ile | Ile/Phe | NS4B-44 | 2286 |
| 7162 | T | C | Leu | Ser | NS4B-112 | 2354 |
| 7546 | C | C/T | Ala | Ala/Val | NS4B-240 | 2366 |
| 7623 | G | T/G | Asp | Tyr/Asp | NS5-21 | 2508 |

TABLE 6

Summary Of Non-Silent Mutations Between The Genomes Of The Parent-Vaccine Strains Of DEN-1, DEN-2, DEN-3, And DEN-4 Viruses

| Genome Nucleotide Position | DEN-1 | DEN-2 | DEN-3 | DEN-4 |
|---|---|---|---|---|
| 57 | | 5'NC-57 c–t | | |
| 524 | | prM-29 D–V | | |
| 1323 | E-130 V–A | | | |
| 1521 | | | E-196 S/L–S | |
| 1541) | | | | |
| 1543) | E-203 E–K | | | |
| 1545 | E-204 R–K | | | |
| 1608 | E-225 S–L | | | |
| 1838 | | | E-302 S–G | |
| 1913 | | | E-327 E–K | |
| 1971 | | | | E-345 E–K |
| 2363 | E-477 M–V | | | |
| 2579 | | NS1-53 G–D | | |
| 3182 | | | | NS1-253 Q–H |
| 3725 | | | NS2A-86 F–L | |
| 4018 | | NS2A-181 L–F | | |
| 4781 | | | NS3-90 Q–K | |
| 5063 | NS3-182 E–K | | | |
| 5270 | | NS3-250 E–V/E | | |
| 6048 | NS3-510 Y–F | | | |
| 6599 | | NS4A-75 G–A | | |
| 6660 | | | | NS4A-95 L–F |

TABLE 6-continued

Summary Of Non-Silent Mutations Between The Genomes Of The Parent-Vaccine Strains Of DEN-1, DEN-2, DEN-3, And DEN-4 Viruses

| Genome Nucleotide Position | DEN-1 | DEN-2 | DEN-3 | DEN-4 |
|---|---|---|---|---|
| 6806 | NS4A-144 M–V | | | |
| 6957 | | | | NS4B-44 I—I/F |
| 7162 | | | | NS4B-112 L–S |
| 7546 | | | | NS4B-240 A—A/V |
| 7623 | | | | NS5-21 D—D/Y |

TABLE 7

Immunogenicity of viruses in mice.
Plaque reduction-neutralization titer[a] against DEN-1 16007 virus

| | Experiment 1[b] | | Experiment 2[b] | |
|---|---|---|---|---|
| Immunizing virus | Primary Pooled sera (Range) | Boost Pooled sera (Range) | Primary Pooled sera (Range) | Boost Pooled sera (Range) |
| DEN-1 16007 | 80 (20–80) | 2560 (80–20480) | 80 (20–160) | 2560 (160–5120) |
| D2/1-PP | 80[c] | 5120[c] | 40 (10–160) | 5120 (160–10240) |
| D2/1-EP | 80 (20–320) | 10240 (640–20480) | 160 (20–320) | 5120 (2560–≧10240) |
| D2/1-VP | 40 (10–160) | 2560 (160–5120) | 80 (20–320) | 5120 (40–≧10240) |
| DEN-1 PDK-13 | 10 (10–40) | 80[c] | 40 (20–80) | 320 (20–640) |
| D2/1-PV | 10 (<10[d]–20) | 80[c] | 40 (10–80) | 2560 (20–≧10240) |
| D2/1-EV | 20 (<10[d]–20) | 80[c] | 40 (<10[d]–40) | 160 (10–320) |
| D2/1-VV | 10 (10–40) | 80[c] | 40 (10–160) | 160 (20–640) |

[a]Titers are the reciprocal dilution yielding at least 50% plaque reduction.
[b]3-week-old outbred ICR mice were immunized intraperitoneally with $10^4$ PFU of virus, and were boosted with the same virus dose 3 weeks later in experiment 1, or 6 weeks later in experiment 2. Primary = serum taken 20 days (experiment 1) or 41 days (experiment 2) after primary immunization. Boost = serum taken 21 days after boost in both experiments.
[c]Individual titers were not determined.
[d]Only one mouse serum titer was less than 10 in these groups.
[e]Bold titers indicate the pooled sera titers were 4 fold higher than the titers calculatedwith 70% plaque reduction. All other pooled titers were either no different from or two fold higher than 70% plaque reduction titers.

TABLE 8

Neutralization of chimeric DEN viruses by standard antibodies

| | Antibody | | | | | |
|---|---|---|---|---|---|---|
| Virus | D1-AF[a] | D2-AF[a] | D2-H5[b] | D3-AF[a] | D3-8A1[b] | D4-AF[a] |
| DEN-1 16007[c] | 1280[d] | 40 | 20 | 40 | <20 | 20 |
| DEN-2/1-EP[e] | 2560 | ; | ; | ; | ; | ; |
| DEN-2 16681[c] | 80 | 2560> | 40960 | 40 | <20 | 40 |
| DEN-3 16562[c] | 80 | 160 | 40 | 1280 | 5120 | 40 |
| DEN-2/3-EP1[e] | ; | ; | ; | 2560 | 20480 | ; |
| DEN-4 1036[c] | 20 | 40 | <20 | 80 | <20 | 1280 |
| DEN-2/4-EP1[e] | ; | ; | ; | ; | ; | 2560 |

[a]AF = DEN-1 (D1), DEN-2 (D2), DEN-3 (D3), and DEN-4 (D4) virus-specific mouse ascitic fluids (polyvalent antisera).
[b]DEN-2 and DEN-3 virus-specific, envelope glycoprotein-specific (E-specific) monoclonal antibodies D2-H5 and D3-8A1, respectively.
[c]Wild-type DEN virus.
[d]Reciprocal serum dilution-plaque reduction neutralization titers (50% endpoint) are shown; ; = not tested
[e]Chimeric DEN-2/1-EP, DEN-2/3-EP1, or DEN-2/4-EP1 virus expressing structural genes of DEN-1 16007, DEN-3 16562, or DEN-4 1036 virus, respectively.

TABLE 9

Neurovirulence of chimeric DEN-2/3 and DEN-2/4 viruses in newborn white ICR mice

| Challenge Virus[a] | Percent Mortality[b] | AST (SD) (days)[c] |
|---|---|---|
| DEN-3 16562[d] | 100.0 | 14.1 (2.1) |
| DEN-3 P30/FRh1-3[e] | 15.0 | 16.2 (3.2) |
| DEN-2/3-PP1[f] | 32.5 | 19.0 (2.1) |
| DEN-2/3-EP1[f] | 0.0 | — |
| DEN-2/3-VP1[f] | 0.0 | — |
| DEN-4 1036[d] | 100.0 | 8.6 (0.6) |
| DEN-4 PDK-48[e] | 100.0 | 10.7 (1.5) |
| DEN-2/4-PP1[f] | 62.5 | 17.8 (2.8) |
| DEN-2/4-EP1[f] | 0.0 | — |
| DEN-2/4-VP1[f] | 0.0 | — |
| DEN-2 16681[d] | 87.5 | 15.2 (2.6) |
| DEN-2 PDK53-E48[e] | 0.0 | — |

TABLE 9-continued

Neurovirulence of chimeric DEN-2/3 and DEN-2/4 viruses in newborn white ICR mice

| Challenge Virus[a] | Percent Mortality[b] | AST (SD) (days)[c] |
|---|---|---|
| DEN-2 PDK53-V48[e] | 0.0 | — |
| Diluent | 0.0 | — |

[a]Newborn mice were challenged intracranially with 10[4] PFU of virus.
[b]{Number of fatalities/total number (n = 16) of mice challenged} × 100.
[c]Average survival time (AST) and standard deviation (SD); — =not applicable, becausE there were no fatalities in this group.
[d]Wild-type DEN serotype virus
[e]Mahidol candidate DEN vaccine virus: DEN-3 = PGMK-30/FRhL-3 (P30/FRhL-3); DEN-4 = PDK-48; DEN-2 = PDK-53-E variant (NS3-250-Glu locus) and PDK-53-V variant (NS3-250-Val locus). Both PDK-53-E and -V variant viruses were derived from infectious cDNA clones of the variants.
[f]Chimeric DEN-2/3 or DEN-2/4 virus. The prM/E gene region of DEN-3 16562 virus or DEN-4 1036 virus was expressed in the genetic background of wild-type DEN-2 16681 virus (PP1 viruses), Mahidol candidate vaccine DEN-2 PDK-53-E variant (EP1 viruses), or Mahidol candidate vaccine DEN-2 PDK-53-V variant (VP1 viruses).

TABLE 10

Protective efficacy of chimeric DEN-2/1 viruses in AG-129 mice[a]
Reciprocal neutralizing antibody titer against appropriate homologous DEN-3 or DEN-4 virus at 4 or 6 weeks after immunization

| Immunizing Virus | 4 weeks | 6 weeks |
|---|---|---|
| DEN-3 16562[b] | 320[c] | 640 |
| DEN-3 P30/FRhL-3[d] | 160 | 320 |
| DEN-2/3-EP1[e] | 80 | 320 |
| DEN-4 1036[b] | 160 | 1280 |
| DEN-4 PDK-48[d] | 80 | 320 |
| DEN-2/4-EP1[e] | 20 | 40 |

[a]AG-129 mice are an inbred strain that lack receptors for interferon alpha/beta and interferon gamma. Mice, 3.5–4.5 weeks in age, were immunized intraperitoneally with 10[5] PFU of virus.
[b]Wild-type DEN virus.
[c]Reciprocal dilution of pooled serum that neutralized 70% or greater of the input wild-type DEN-3 16562 virus that was used to test sera from mice immunized with DEN-3 or chimeric DEN-2/3-EP1 virus, or the input wild-type DEN-4 1036 virus that was used to test sera from mice immunized with DEN-4 or chimeric DEN-2/4-EP1 virus.
[d]Mahidol candidate vaccine virus, DEN-3 PGMK-30/FRhL-3 (P30/FRhL-3), DEN-4 PD-48.
[e]Chimeric DEN-2/3-EP1 or DEN-2/4-EP1 expressing the prM/E gene region of DEN-3 16562 or DEN-4 1036 virus, respectively.

TABLE 11

Genotypes of recombinant DEN-2 16681/PDK-53 viruses

| Clone-derived virus (cognate)[b] | 5'NC-57 | prM-29 | NS1-53 | NS2A-181 | NS3-250 | NS4A-75 |
|---|---|---|---|---|---|---|
| Dengue-2 16681 determinants in PDK-53 background[a] | | | | | | |
| DEN-2 PDK-53 VV45R (V513) | t | V | D | F | V | A |
| P5 (V13) | c | . | . | . | . | . |
| P1 (V53) | . | . | G | . | . | . |
| P3 (V51) | . | . | . | . | E | . |
| P51 (V3) | c | . | G | . | . | . |
| P53 (V1) | c | . | . | . | E | . |
| P13 (V5) | . | . | G | . | E | . |
| P513 (30P-A) | c | . | G | . | E | . |
| Dengue-2 PDK-53 determinants in 16681 background[c] | | | | | | |
| DEN-2 16681 30P-A (P513) | c | D | G | L | E | G |
| V5 (P13) | t | . | . | . | . | . |
| V1 (P53) | . | . | D | . | . | . |
| V3 (P51) | . | . | . | . | V | . |
| V51 (P3) | t | . | D | . | . | . |
| V53 (P1) | . | . | . | . | V | . |
| V13 (P5) | . | . | D | . | V | . |
| V513 (VV45R) | t | . | D | . | V | . |

[a]The genome of the candidate dengue-2 PDK-53 vaccine virus differs from that of its 16681 parent at nine nucleotide loci, including three silent mutations (not shown), a mutation at genome nucleotide position 57 in the 5' noncoding region (5'NC-57; lower case letters), and five nucleotides encoding amino acid mutations (upper case, single-letter abbreviations) at viral polypeptide positions premembrane (prM)-29, nonstructural protein 1 (NS1)-53, NS2A-181, NS3-250, and NS4A-75 (32). Genetic loci from the parental 16681 virus were engineered into the cDNA background of the PDK-53 virus-specific infectious clone, pD2/IC-VV45R. Dots indicate sequence identity with PDK-53 virus (NS3-250-Val variant). The candidate PDK-53 vaccine also contains a genetic variant that has Glu at NS3-250 (32).
[b]The genotypes of wild-type DEN-2 16681 virus, its attenuated vaccine derivative, DEN-2 PDK-53 virus, infectious clone-derived VV45R (genetically equivalent to the PDK-53 NS3-250- Val variant) and 30P-A (equivalent to wild-type DEN-2 16681) viruses, and recombinant 16681/PDK-53 viruses are shown. The numerical designations for recombinant Px and Vx viruses (where x = 5'NC, NS1, and/or NS3 loci) indicate parental (P in virus designation) 16681 virus-specific loci engineered into the PDK-53 virus-specific infectious cDNA clone (top series) or reciprocal candidate PDK-53 vaccine (V in virus designation) virus-specific loci engineered into the 16681 clone (bottom series), respectively. P5 and V13 are cognate viruses, assuming that the PDK-53 virus-specific phenotype is determined predominantly by the 5'NC-57, NS1-53, and NS3-250 loci. Both P5 and V13 viruses contain the 5'NC-57-c, NS1-53-Asp, and NS3-250- Val loci within the genetic backgrounds of PDK-53 and 16681 viruses, respectively.
[c]Genetic loci from PDK-53 virus were engineered into the cDNA background of the 16681 virus-specific infectious clone, pD2/IC-30P-A. Dots indicate sequence identity with 16681 virus.

TABLE 12

Neurovirulence of DEN-2 16681, PDK-53, and recombinant 16681/PDK-53 viruses in newborn white ICR mice

| Virus (cognate)[c] | Mouse challenge[a] Mortality (%) | AST (SD) (days) | Virus genotype[b] 5'-NC 57 | prM 29 | NS1 53 | NS2A 181 | NS3 250 | NS4A 75 |
|---|---|---|---|---|---|---|---|---|
| DEN-2 16681 | 68.75 | 15.2 (1.2) | c | D | G | L | E | G |
| 30P-A (P513) | 81.25 | 14.6 (2.3) | . | . | . | . | . | . |
| P513 (16681) | 50.0 | 13.2 (1.6) | . | V | . | F | . | A |
| P51 (V3) | 100[d] | 15.9 (5.5) | . | V | . | F | V | A |
| P1 (V53) | 37.5[d] | 19.0 (4.2) | t | V | . | F | V | A |
| P13 (V5) | 37.5[d] | 13.5 (2.1) | t | V | . | F | . | A |
| P53 (V1) | 20.0[d] | 17.0 (7.8) | . | V | D | F | . | A |

TABLE 12-continued

Neurovirulence of DEN-2 16681, PDK-53, and recombinant 16681/PDK-53 viruses in newborn white ICR mice

| Virus (cognate)[c] | Mouse challenge[a] | | Virus genotype[b] | | | | | |
|---|---|---|---|---|---|---|---|---|
| | Mortality (%) | AST (SD) (days) | 5'-NC 57 | prM 29 | NS1 53 | NS2A 181 | NS3 250 | NS4A 75 |
| P5p (V13) | 6.25 | 15.0 | . | . | D | F | V | A |
| P5 (V13) | 6.25 | 27.0 | . | V | D | F | V | A |
| Pp (PDK-53) | 0 | —[e] | t | . | D | F | V | A |
| P3 (V51) | 0 | — | t | V | D | F | . | A |
| V3 (P51) | 75.0[d] | 16.4 (3.2) | . | . | . | . | V | . |
| Vp (16681) | 87.5 | 17.0 (0.9) | . | V | . | . | . | . |
| V53 (P1) | 18.75[d] | 21.3 (6.1) | t | . | . | . | V | . |
| V5 (P13) | 18.75[d] | 21.7 (4.2) | t | . | . | . | . | . |
| V5p (P13) | 6.25 | 20.0 | t | V | . | . | . | . |
| V13(P5) | 6.25 | 17.0 | . | . | D | . | V | . |
| V1 (P53) | 6.25 | 22.0 | . | . | D | . | . | . |
| V51 (P3) | 0 | — | t | . | D | . | . | . |
| V513 (PDK-53) | 0 | — | t | . | D | . | V | . |
| VV45R (V513) | 0 | — | t | V | D | F | V | A |
| DEN-2 PDK-53 | 0 | — | t | V | D | F | V | A |

[a]Percent mortality and average survival time (AST) ± standard deviation (SD) of newborn, outbred white ICR mice challenged intracranially with $10^4$ PFU of virus. Sixteen mice per group, except for the P53 and Vp groups in which a single mouse died by day 1 after infection, presumably as a result of inoculation trauma. These two mice were excluded from the study.
[b]See text for explanation of virus genotypes. Solid dots indicate sequence identity with 16681 virus.
[c]See text for explanation of virus and cognate virus designations.
[d]Mean body weight of surviving mice was significantly lower (p < 0.001, Student's t test) than that of diluent-inoculated control mice (not shown) at 3 weeks after infection.
[e]Average survival time is not applicable because there was no mortality in this mouse group.

TABLE 13

Evolution of DEN-2 virus, vaccine strain PDK-53, during passage of the parental 16681 strain in primary dog kidney (PDK) cells

| | Genome nucleotide position[a]/Translated polypeptide position[b]/Encoded amino acids[c] | | | | | | | | |
|---|---|---|---|---|---|---|---|---|---|
| Virus | 57[a] | 524 prM-29[b] D–V[c] | 2055 E-373 F—F | 2579 NS1-53 G–D | 4018 NS2A-181 L–F | 5270 NS3-250 F–V | 5547 NS3-342 R—R | 6599 NS4A-75 G–A | 8571 NS5-334 V—V |
| 16681 | C[d] | A | C | G | C | A | T | G | C |
| PDK-5 | C | A | C/T[e] | G | T/C | A | T/C | G | C/T |
| PDK-10 | C | A | T/C | G | T | A | C/T | G | T/C |
| PDK-14 | C | A | T | G | T | A | C | G | T/C |
| PDK-35 | T | T/A | T | A/G | T | A | C | C/G | T |
| PDK-45 | T | T | T | A | T | A/T | C | C | T |
| PDK-53 | T | T | T | A | T | A/T | C | C | T |

[a]Genome nucleotide positions of the nine nucleotide sequence differences between 16681 and PDK-53 viruses. Nucleotide position 57 lies within the 5' noncoding region of the viral genome.
[b]Protein designations are as follows: prM = premembrane protein; E = envelope glycoprotein; NS = non-structural protein.
[c]The virus-specific amino acid residues (16681-PDK-53) are shown for each amino acid position.
[d]A, C, G, and T (cDNA sense) nucleotides are indicated.
[e]Two genetic populations were identified for this locus in the virus. The order of the two nucleotides reflects relative peak heights of the nucleotide signals in sequence chromatograms.

TABLE 14

Conservation of DEN-2 PDK-53 phenotypic attenuation markers in chimeric DEN viruses.

| | DEN virus | | | |
|---|---|---|---|---|
| Attenuation phenotype | DEN-2[a] | DEN-2/1 | DEN-2/3 | DEN-2/4 |
| Attenuation in mice | + | + | + | + |
| Decreased replication in | + | + | + | + |
| C6/36 cells | | | | |
| Small plaques in | + | + | + | + |

TABLE 14-continued

Conservation of DEN-2 PDK-53 phenotypic attenuation markers in chimeric DEN viruses.

| Attenuation phenotype | DEN virus | | | |
|---|---|---|---|---|
| | DEN-2[a] | DEN-2/1 | DEN-2/3 | DEN-2/4 |
| LLC-MK$_2$ cells | | | | |
| Temperature sensitivity in LLC-MK$_2$ cells | + | + | + | + |

[a]Mahidol candidate DEN-2 PDK-53 vaccine virus. The chimeric DEN-2/1, DEN-2/3, and DEN-24 viruses were constructed in the DEN-2 PDK-53 genetic background, NS3-250-Val or -Glu variant. The phenotypes shown for chimeric viruses are representative of chimeric viruses constructed in the background of either variant of DEN-2 PDK-53 virus.

TABLE 15

Diagnostic Genetic Probes and Amplimers for the Candidate Mahidol DEN-1, DEN-2, DEN-3, and DEN-4 Vaccine Viruses.
Genetic Locus: D1V-1323 = Mutated genetic locus for candidate DEN-1 PDK-13 vaccine (V) virus at genome nucleotide position 1323.
Primer designations:
  p = TaqMan probe sequence, mRNA-sense
  pc = TaqMan probe sequence, complementary-sense
  f = forward amplimer, mRNA-sense
  r = reverse amplimer, complementary-sense
SEQ ID = probe or primer sequence.

| Genetic Locus | Primer Designation | SEQ ID NO: |
|---|---|---|
| D1V-1323 | | |
| Probe | pcD1V-1308 | 44 |
| F | fD1V-1298 | 45 |
| R | rD1V-1347 | 46 |
| D1V-1541, 1543, 1545 | | |
| Probe | pcD1V-1530 | 47 |
| F | fD1V-1519 | 48 |
| R | rD1V-1567 | 43 |
| D1V-1567 | | |
| Probe | pD1V-1580 | 50 |
| F | fD1V-1545 | 51 |
| R | rD1V-1608 | 52 |
| D1V-1608 | | |
| Probe | pcD1V-1595 | 53 |
| F | fD1V-1567 | 54 |
| R | rD1V-1626 | 55 |
| D1V-2363 | | |
| Probe | pD1V-2374 | 56 |
| F | fD1V-2334 | 57 |
| R | rD1V-2386 | 58 |
| D1V-2695 | | |
| Probe | pcD1V-2686 | 59 |
| F | fD1V-2660 | 60 |
| R | rD1V-2735 | 61 |
| D1V-2782 | | |
| Probe | pD1V-2767 | 62 |
| F | fD1V-2752 | 63 |
| R | rD1V-2801 | 64 |
| D1V-5063 | | |
| Probe | pcD1V-5052 | 65 |
| F | fD1V-5040 | 66 |
| R | rDLV-5095 | 67 |
| D1V-6048 | | |
| Probe | pD1V-6059 | 68 |
| F | fD1V-6030 | 69 |
| R | rD1V-6069 | 70 |
| D1V-6806 | | |
| Probe | pcD1V-6793 | 71 |
| F | fD1V-6780 | 72 |
| R | rD1V-6825 | 73 |
| D1V-7330 | | |
| Probe | pD1V-7343 | 74 |
| F | fD1V-7310 | 75 |
| R | rD1V-7351 | 76 |
| D1V-9445 | | |
| Probe | pcD1V-9433 | 77 |
| F | fD1V-9419 | 78 |
| R | rD1V-9485 | 79 |
| D2V-57 | | |
| Probe | pD2V-69 | 80 |
| F | fD2V-32 | 81 |
| R | rD2V-81 | 82 |
| D2V-524 | | |
| Probe | pcD2V-513 | 83 |
| F | fD2V-492 | 84 |
| R | rD2V-551 | 85 |
| D2V-2055 | | |
| Probe | pD2V-2067 | 86 |
| F | fD2V-2025 | 87 |
| R | rD2V-2080 | 88 |
| D2V-2579 | | |
| Probe | pcD2V-2568 | 89 |
| F | fD2V-2535 | 90 |
| R | rD2V-2603 | 91 |
| D2V-4018 | | |
| Probe | pD2V-4030 | 92 |
| F | fD2V-3993 | 93 |
| R | rD2V-4043 | 94 |
| D2V-5270-E D2V-5270-V | | |
| ProbeE | pD2VE-5279 | 95 |
| ProbeV | pD2VV-5279 | 96 |
| F | fD2V-5243 | 97 |
| R | rD2V-5295 | 98 |
| D2V-5547 | | |
| Probe | pD2V-5558 | 99 |
| F | fD2V-5521 | 100 |
| R | rD2V-5589 | 101 |
| D2V-6599 | | |
| Probe | pcD2V-6588 | 102 |
| F | fD2V-6569 | 103 |
| R | rD2V-6625 | 104 |

TABLE 15-continued

Diagnostic Genetic Probes and Amplimers for the Candidate Mahidol
DEN-1, DEN-2, DEN-3, and DEN-4 Vaccine Viruses.
Genetic Locus: D1V-1323 = Mutated genetic locus for candidate
DEN-1 PDK-13 vaccine (V) virus at
genome nucleotide position 1323.
Primer designations: p = TaqMan probe sequence,
mRNA-sense
pc = TaqMan probe sequence,
complementary-sense
f = forward amplimer, mRNA-sense
r = reverse amplimer,
complementary-sense
SEQ ID = probe or primer sequence.

| Genetic Locus | Primer Designation | SEQ ID NO: |
|---|---|---|
| D2V-8571 | | |
| Probe | pD2V-8582 | 105 |
| F | fD2V-8535 | 106 |
| R | rD2V-8594 | 107 |
| D3V-550 | | |
| Probe | pD3V-562 | 108 |
| F | fD3V-525 | 109 |
| R | rD3V-575 | 110 |
| D3V-1521 | | |
| Probe | pD3V-1533 | 111 |
| F | fD3V-1497 | 112 |
| R | rD3V-1541 | 113 |
| D3V-1813 | | |
| Probe | pcD3V-1804 | 114 |
| F | fD3V-1767 | 115 |
| R | rD3V-1838 | 116 |
| D3V-1838 | | |
| Probe | pcD3V-1827 | 117 |
| F | fD3V-1813 | 118 |
| R | rD3V-1913 | 119 |
| D3V-1913 | | |
| Probe | pcD3V-1903 | 120 |
| F | fD3W1891 | 121 |
| R | rD3V-1967 | 122 |
| D3V-2140 | | |
| Probe | pcD3V-2127 | 123 |
| F | fD3V-2116 | 124 |
| R | rD3V-2188 | 125 |
| D3V-3725 | | |
| Probe | pD3V-3738 | 126 |
| F | fD3V-3698 | 127 |
| R | rD3V-3745 | 128 |
| D3V-4781 | | |
| Probe | pcD3V-4772 | 129 |
| F | fD3V-4762 | 130 |
| R | rD3V-4801 | 131 |
| D4V-1211 (T-C) | | |
| Probe | pD4V-1222 | 132 |
| F | fD4V-1191 | 133 |
| R | rD4V-1250 | 134 |
| D4V-1971 (G-A) | | |
| Probe | pcD4V-1957 | 135 |
| F | fD4V-1943 | 136 |
| R | rD4V-2010 | 137 |
| D4V-3182 (G-C) | | |
| Probe | pD4V-3193 | 138 |
| F | fD4V-3154 | 139 |
| R | rD4V-3227 | 140 |
| D4V-6660 (C-T) | | |
| Probe | pcD4V-6648 | 141 |
| F | fD4V-6638 | 142 |
| R | rD4V-6688 | 143 |
| D4V-7162 (T-C) | | |
| Probe | pD4V-7174 | 144 |
| F | fD4V-7141 | 145 |
| R | rD4V-7188 | 146 |

TABLE 16

SEQ ID NO: for TaqMan probes and amplimers.

| SEQ ID NO: | |
|---|---|
| 44 | 5'-TTCATATTGAGCTATCTTTCCTTCTA-3' |
| 45 | 5'-GTGTGCCAAGTTTAAGTGTG-3' |
| 46 | 5'-TGGACGGTGACTATCACTG-3' |
| 47 | 5'-AAGCCATGATTTCTTTTTCATTGTCA-3' |
| 48 | 5'-CAGGGCTAGATTTTAACGAG-3' |
| 49 | 5'-AGTGGTAAGTCTAGAAACCAC-3' |
| 50 | 5'-TCCACAAACAGTGGTTTCTAGACT-3' |
| 51 | 5'-TGTTGCTGACAATGAAAAAGAA-3' |
| 52 | 5'-TCCAAGTCTCTTGGGATGTTA-3' |
| 53 | 5'-TGGGATGTTAAAGCCCCAGAGGT-3' |
| 54 | 5'-TCATGGCTTGTCCACAAACAG-3' |
| 55 | 5'-CCAGTAAATCTTGTCTGTTCC-3' |
| 56 | 5'-CGTCCCTTTCGGTGATGTGCATC-3' |
| 57 | 5'-ATTCTGCTGACATGGCTAGG-3' |
| 58 | 5'-TCCTAGGTACAGTGTGACC-3' |
| 59 | 5'-AGATTCCACTAACGTCTCCCACG-3' |
| 60 | 5'-AATTGAACCACATCCTACTTG-3' |
| 61 | 5'-TTGTGTTCCATGGGTTGTGG-3' |
| 62 | 5'-TATGATTTTAGCTTTTCCCCAGCTT-3' |
| 63 | 5'-GCCACAACCCATGGAACAC-3' |
| 64 | 5'-ATGAAGGTGGTGTTCTGTAC-3' |
| 65 | 5'-TCCTAAACACCTTGTCCTCAATCT-3' |
| 66 | 5'-GCTAAGGCATCACAAGAAGG-3' |

TABLE 16-continued

SEQ ID NO: for TaqMan probes and amplimers.

| SEQ ID NO: | |
|---|---|
| 67 | 5'-CGATCCTGGATGTAGGTCC-3' |
| 68 | 5'-CAGCCCTCTTTGAGCCGGAGA-3' |
| 69 | 5'-AATATAAACACACCAGAAGG-3' |
| 70 | 5'-TCCCCGTCTATAGCTGCAC-3' |
| 71 | 5'-TGTCAATATCACGAATAACAGACCT-3' |
| 72 | 5'-CACAGGACAACCAGCTAGC-3' |
| 73 | 5'-AATAATCCCATCTCATTGG-3' |
| 74 | 5'-ATTTGAAAAACAGCTAGGCCAAATAA-3' |
| 75 | 5'-CTTAGATCCCGTGGTTTACG-3' |
| 76 | 5'-AATCTGTGATGTGCAAAGTATC-3' |
| 77 | 5'-AAAGATTCCCTCAGACTCCATTTGT-3' |
| 78 | 5'-CACTTTCACCAACATGGAGG-3' |
| 79 | 5'-CGAGAACTCTTCCGGCTAG-3' |
| 80 | 5'-AGCTAAGCTCAATGTAGTCTAACA-3' |
| 81 | 5'-CGTGGACCGACAAAGACAG-3' |
| 82 | 5'-TCATCAGAGATCTGCTCTCT-3' |
| 83 | 5'-ATGTTCACGCCAACCTCTGTTTTA-3' |
| 84 | 5'-GATCGTCAGCAGACAAGAG-3' |
| 85 | 5'-CAATTCACCAAGGTCCATGG-3' |
| 86 | 5'-AACCTCCATTTGGAGACAGCTAC-3' |
| 87 | 5'-AATTGTGACAGAAAAAGATAGC-3' |
| 88 | 5'-TCAGTTGTCCCGGCTCTAC-3' |
| 89 | 5'-ATTCCACAAATGTCCTCTTCATGG-3' |
| 90 | 5'-TACAAGTTCCAACCAGAATCC-3' |
| 91 | 5'-CATCAGATTCTCCAGTCTTG-3 |
| 92 | 5'-TTTCCCCACTGTTCTTAACATCCT-3' |
| 93 | 5'-GAAAGTGAGTTGCACAATATTG-3' |
| 94 | 5'-ATGCTAATGGTATCCAATCTG-3' |
| 95 | 5'-CATCAGAGCTGAGCACACCGG-3' |
| 96 | 5'-CATCAGAGCTGTGCACACCGG-3' |
| 97 | 5'-CCTTAGAGGACTTCCAATAAG-3' |
| 98 | 5'-AATGTGGCATGACACATTAGG-3' |
| 99 | 5'-ATCCCTGAACGCTCGTGGAATTC-3' |
| 100 | 5'-AGAGCAATGCACCAATCATAG-3' |
| 101 | 5'-GAACGAACCAAACAGTCTTC-3' |
| 102 | 5'-TATGCCCCTTGCGCTCATCAAG-3' |
| 103 | 5'-CACTTCTGGCTACAGTCAC-3' |
| 104 | 5'-GTGATTATGCAGCACATTCC-3' |
| 105 | 5'-CTTGGGACGTTGTCCCCATGGT-3' |
| 106 | 5'-CAGCATCATCCATGGTCAAC-3' |
| 107 | 5'-GGAGTCGTGTCTGTCATTG-3' |
| 108 | 5'-CACTCATAGCTATGGATCTGGGA-3' |
| 109 | 5'-CTTTTCAAGACAGCCTCTGG-3' |
| 110 | 5'-CATTTGTAAGTGACCGTGTC-3' |
| 111 | 5'-CAATGAAATGATCTCATTGACAATGAA-3' |
| 112 | 5'-AATGCTCACCACGGACAGG-3' |
| 113 | 5'-TTGTCTATGTACCATCCATGC-3' |
| 114 | 5'-CATAGCTCATCCCTTTGAGTTCC-3' |
| 115 | 5'-GAGGCACAAGTATCTTTGC-3' |
| 116 | 5'-TTTCTTCAACACAAAGCTACC-3' |
| 117 | 5'-ACACAAAGCTACCCAAGCACATTG-3' |
| 118 | 5'-GATGGACAAATTGGAACTCAAA-3' |
| 119 | 5'-ATCTTGCAGGGTGCATCTTT-3' |
| 120 | 5'-AGGGTGCATCTTTCCCTTTGTAC-3' |
| 121 | 5'-GCAGCATGGGACAATACTC-3' |
| 122 | 5'-GTGATCAGTCTGCCATTGTG-3' |
| 123 | 5'-CCTCTGGCAGTAGCCTCGAACATCT-3' |
| 124 | 5'-ACTGGTACAAGAAGGGAAGC-3' |
| 125 | 5'-ACCCACTGATCCAAAGTCC-3' |
| 126 | 5'-TCAGCCACTCCTGGCTTTGGG-3' |
| 127 | 5'-GGCGTCACTTACCTAGCTC-3' |
| 128 | 5'-TAGATGTCAGTTTCCTCAGG-3' |
| 129 | 5'-CCTCCCCCTTTTTCCATTGTGC-3' |
| 130 | 5'-TTTCATACGGAGGAGGATGG-3' |
| 131 | 5'-AGGCTCTACGGCAATAACC-3' |
| 132 | 5'-CAACAGTACATCTGCCGGAGAGA-3' |
| 133 | 5'-GAGAGCCTTATCTAAAAGAGG-3' |
| 134 | 5'-CTTTTCCAAACAAGCCACAG |
| 135 | 5'-AACCACTTTTTTCTTGTTCACATCTC |
| 136 | 5'-TGGAGCTCCGTGTAAAGTC-3' |
| 137 | 5'-GCACTGTTGGTATTCTCAGC-3' |
| 138 | 5'-CCCTTTTTCACACCACAATTACCG-3' |
| 139 | 5'-GAAAGCCAGATGCTCATTCC-3' |
| 140 | 5'-TATCTCTAATTTGCCTAAGTGC-3' |
| 141 | 5'-CTACCCAGAACAAGCCACTAGC-3' |

TABLE 16-continued

| SEQ ID NO: for TaqMan probes and amplimers. | |
|---|---|
| SEQ ID NO: | |
| 142 | 5'-ATTGTCAATGGGTTTGATAACC-3' |
| 143 | 5'-TATGATTGAGGCCGCTATCC-3' |
| 144 | 5'-TAGTCATGCTTTCAGTCCATTATGC-3' |
| 145 | 5'-AGTGAACCCAACAACTTTGAC-3' |
| 146 | 5'-TGGCTTTTGCCTGCAATCC-3' |

Underlined residues indicate the positions of the candidate vaccine virus mutation within the primer sequence, or, in the case of SEQID #52, the underlined residue indicates the nt-5270 position of DEN-2 16681 virus.

SEQUENCE LISTING (148 sequences)

SEQ ID NO: 1 - DNA, 10735 bp, Artificial Sequence
  Description of Artificial Sequence:/Note = synthetic construct
  CDS (95)...(10273)
agttgttagtctacgtggaccgacaagaacagtttcgaatcggaagcttgcttaacgtagttctaacagttttttattagagagcagatctctgatgatcaaccaacgaaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcttaagatttctagccatacccccaacagcaggaattttggctagatggggctcattcaagaagaatggagcgattaaagtgttacggggtttcaagagagaaatctcaaacatgctaaacataatgaacaggaggaaaagatccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggtttctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagttggcatggtcacactgtacctaggagtcatggttcaggcagattcgggatgtgtaatcaactggaaaggcagagaacttaaatgtggaagcggcatttttgtcactaatgaagttcacacttggacagagcaatacaaattccaggctgactcccccaagagactatcagcagccattgggaaggcatgggaggagggtgtgtgtggaatccgatcagccactcgtctcgagaacatcatgtggaaacaaatatcaaatgaattgaaccacatcctacttgaaaatgacatgaaatttacagtggtcgtgggagatgttagtggaatcttggcccaagggaaaaaaatgattaggccacaacccatggaacacaaatactcgtggaaaagctggggaaaagccaaaatcataggagcggatgtacagaacaccaccttcatcatcgacggcccaaacaccccagaatgccctgacaatcaaagagcatggaatatttgggaagtagaggactatggatttgggattttcacgacaaacatatggttgaaattgcgtgactcctacacccaagtatgtgaccaccggctgatgtcagctgccattaaggacagcaaggcagtccatgctgacatggggtactggatagaaagtgaaaagaacgagacatggaagttggcgagagcctcctttatagaagttaagacatgcatctggccaaaatcccacactctatggagcaatggagttctggaaagtgaaatgataattccaaagatatatggaggaccaatatctcagcacaactacagaccaggatatttcacacaaacagcagggccgtggcacctaggcaagttggaactagatttcgatttttgtgaaggtaccacagttgttgtggatgaacattgtggaaatcgaggaccatctctcagaaccacaacagtcacaggaaagataatccatgaatggtgctgcagatcttgtacgctaccccccctacgtttcaaaggggaagacgggtgttggtacggcatggaaatcagaccagtgaaggacaaggaagagaacctggtcaagtcaatggtctctgcagggtcaggagaagtggacagcttttcactaggactgctatgcatatcaataatgattgaagaagtgatgagatccagatggagcaaaaaaatgctgatgactggaacactggctgtgttcctccttcttataatgggacaattgacatggagtgatctgatcaggttatgtattatggttggagccaacgcttcagacaagatggggatgggaacaacgtacctagctttaatggccactttcaaaatgagaccaatgttcgccgtcgggctattatttcgcagactaacatctagagaagttcttcttcttacaattggcttgagcctggtggcatccgtggagctaccaagttccctagaggagctgggggatggacttgcaataggcatcatgatgttgaaattattgactgattttcagtcacaccagctatgggctactctgctatccttgacatttattaaaacaactttttcattgcactatgcatggaagacaatggctatggtactgtcaattgtatctctcttccctttatgcctgtccacgacctctcaaaaaacaacatggcttccggtgctgttgggatctcttggatgcaaaccactacccatgtttcttataacagaaaacaaaatctggggaaggaagagttggcccctcaatgaaggaattatggctgttggaatagttagtattctactaagttcacttttaaaaaatgatgtgccgctagccggcccattaatagctggaggcatgctaatagcatgttatgtcatatccggaagctcagctgatttatcactggagaaagcggctgaggtctcctgggaggaagaagcagaacactcaggcgcctcacacaacatactagtagaggttcaagatgatggaaccatgaagataaaagatgaagagagagatgacacgctcaccattctccttaaagcaactctgctggcagtctcaggggtgtacccaatgtcaataccagcgaccctttttgtgtggtatttttggcagaaaaagaaacagagatcaggagtgctatgggacacacccagccccccagaagtggaaagagcagttcttgatgatggcatctatagaattttgcaaagaggactgttgggcaggtcccaagtaggagtaggagttttccaagaaggcgtgttccacacaatgtggcacgtcactaggggagctgtcctcatgtatcaaggaaaaaggctggaaccaagctgggccagtgtcaaaaaagacttgatctcatatggaggaggttggaggtttcaaggatcctggaacacgggagaagaagtacaggtgattgctgttgaaccgggaaaaaaccccaaaaatgtacaaacaacgccgggtaccttcaagacccctgaaggcgaagttggagccatagccttagactttaaacctggcacatctggatctcccatcgtaaacagagagggaaaaatagtaggtctttatggaaatggagtggtgacaacaagcggaacttacgttagtgccatagctcaagctaaggcatcacaagaagggcctctaccagagattgaggacgaggtgtttaggaaaagaaacttaacaataatggacctacatccaggatcgggaaaaacaagaagataccttccagccatagtccgtgaggccataaaaaggaagctgcgcacgctaatcctagctcccacaagagttgtcgcttctgaaatggcagaggcactcaagggagtgccaataaggtatcagacaacagcagtgaagagtgaacacacaggaaaggagatagttgaccttatgtgccacgccactttcaccatgcgcctcctgtctcccgtgagagttcccaattataacatgattatcatggatgaagcacacttcaccgatccagccagcatagcagccagagggtacatctcaacccgagtgggtatgggtgaagcagctgcgatctttatgacagccactcccccaggatcggtggaggcctttccacagagcaatgcaattatccaagatgaggaaagagacattcctgagagatcatggaactcaggctatgactggatcactgattttccaggtaaaacagtctggtttgttccaagcatcaaatcaggaaatgacattgccaactgtttaagaaaaaacgggaaacgggtgatccaattgagcagaaaaacctttgacactgagtaccagaaaacaaaaaacaacgactgggactatgtcgtcacaacagacatttccgaaatgggagcaaatttccgggccgacagggtaatagacccaaggcggtgtctgaaaccggtaatactaaaagatggtccagagcgcgtcattctagccggaccgatgccagtgactgtggccagtgccgcccagaggagaggaagaattggaaggaaccaaaacaaggaaggtgatcagtatatttacatgggacagcctttaaacaatgatgaggaccacgctcattggacagaagcaaagatgctccttgacaatataaacacaccagaagggattatcccagccctctatgagccggagagagaaaagagtgcagctatagacggggaatacagactgcggggtgaagcaaggaaaacgttcgtggagctcatgagaagaggggatctaccagtctggctatcctacaaagttgcctcagaaggcttccagtactccgacagaaggtggtgcttcgatggggaaaggaacaaccaggtgttggaggagaacatggacgtggagatctggacaaaagaaggagaaagaaagaaactacgacctcgctggttggacgccagaacatactctgacccactggctctgcgcgagtttaaagagtttgcagcaggaagaagaagcgtctcaggtgacctaatattagaaatagggaaacttccacaacatttgacgcaaagggcccagaatgctttggacaacttggtcatgttgcacaattccgaacaaggaggaaaagcctatagacatgctatggaagaactgccagacacaatagaaacgttgatgctcctagccttgatagctgtgttgactggtggagtgacgctgttcttcctatcaggaagaggtctaggaaaaacatctatcggcttactctgcgtgatggcctcaagcgcactgttatggatggccagtgtggagccccattggatagcggcctccatcatactggagttctttctgatggtactgcttattccagagccagacagacagcgcactccacaggacaaccagctagcatatgtggtgataggtctgttattcatgatattgacagtggcagccaatgagatgggattattggaaaccacaaagaaagacctggggattggccatgtagctgctgaaaaccaccaccatgctacaatgctggacgtagacctacatccagcttcagcctggaccctctatgcagtggccacaacaatcatcactcctatgatgagacacacaattgaaaacacaacggcaaatatttccctgacagccatcgcaaaccaagcagctatattgatgggacttgacaagggatggccaatatcgaagatggacataggagttccacttctcgccttggggtgctattcccaagtgaatccgctgacactgatagcggcagtattgatgctagtagctcattacgccataattggacctggactgcaagcaaaagctactagagaagctcaaaaaagaacagcggctggaataatgaaaaatccaactgtcgacgggattgttgcaatagacttagatcccgtggtttacgatgcaaaatttgaaaaacaactaggccaaataatgttgttgatactttgcacatcacagattcttttgatgcggactacatgggccttgtgtgaatccatcacattggctactggacctctgaccactctttgggagggatctccaggaaaattctggaacaccacaatagcggtatccatggcaaacattttcagggggagttatctagcaggagcaggtctggccttctcattaatgaaatctctaggaggaggtaggagaggcacgggagcccaaggggaaacactgggagaaaaatggaaaagacaactaaaccaactgagcaagtcagaattcaatacttacaagaggagtgggattatggaggtggatagatccgaagccaaagagggactgaaaagaggagaaacaaccaaacacgcagtatcgagaggaacggccaaactgaggtggttcgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccaatcccaatggcgacctatggatggaacctagtaaagctgcactccggaaaagatgtattttttataccacctgagaaatgtgacacccttttgtgtgatattggtgagtcctctccgaacccaactatagaggaaggaagaacgttacgtgttctgaaaatggtggaaccatggctcagaggaaaccaattttgcataaaaattctaaatccctatatgccgagcgtggtagaaactctggaacaaatgcaaagaaaacatggaggaatgctagtgcgaaacccactctcaagaaattccacccatgaaatgtactgggtttcatgtggaacaggaaacattgtgtcagcagtaaacatgacatctagaatgttgctaaatcggttcacaatggctcacaggaagccaacatatgaaagagacgtggacttaggcgctggaacaagacatgtggcagtagaaccagaggtagccaacctagatatcattggccagaggatagagaatataaaaaatgaacataagtcaacatggcattatgatgaggacaatccatacaaaacatgggcctatcatggatcatatgaggttaagccatcaggatcggcctcatccatggtcaatggcgtggtgagattgctcaccaaaccatgggatgttatccccatggtcacacaaatagccatgactgataccacaccctttggacaacagagggtgtttaaagagaaagttgacacgcgcacaccaaaagcaaaacgtggcacagcacaaattatggaagtgacagccaggtggttatggggtttcctttctagaaacaaaaaacccagaatttgcacaagagaggagtttacaagaaaagttaggtcaaacgcagctattggagcagtgttcgttgatgaaaatcaatggaactcggcaaaagaagcagtggaagacgaacggttctgggaacttgtccacagagagagggagcttcataaacaggggaaatgtgccacgtgtgtctacaatatgatggggaagagagagaaaaaattaggagagttcggaaaggcaaaaggaagtcgtgcaatatggtacatgtggttgggagcacgcttcctagagtttgaagcccttggtttcatgaatgaagatcactggttcagtagagagaattcactcagtggagtggaaggagaaggactccacaaacttggatacatactcagagacatatcaaggattccaggggggaacatgtatgcagatgacacagccggatgggacacaagaataacagaggatgatctccagaatgaggctaaaatcactgacatcatggagcccgaacatgccctgctggctacgtcaatctttaagctgacctaccaaaataaggtggtaagggtgcagagaccagcaaaaaatggaaccgtgatggatgttatatccagacgtgaccagagaggcagtggacaggttggaacttatggcttaaacactttcaccaacatggaggcccaactgataagacaaatggagtccgagggaatctttttacccagcgaattggaaaccccaaatctagccggaagagttctcgactggttggaaaaatatggtgtcgaaaggctgaaaagaatggcaatcagcggagatgactgtgtggtgaaaccaattgatgacaggttcgcaacagccttaacagctttgaatgacatgggaaaagtaagaaaagacataccacaatgggaaccttcaaaaggatggaatgattggcaacaagtgcctttctgttcacaccacttccaccagctaattatgaaggatgggagggagatagtggtgccatgccgcaaccaagatgaacttgtggggagggccagagtatcacaaggcgccggatggagcctgagagaaaccgcatgcctaggcaagtcatatgcacaaatgtggcagctgatgtatttccacaggagagacctgagactggcggctaacgctatttgttcagccgttccagttgattgggtcccaaccagccgcaccacctggtcgatccatgcccatcaccaatggatgacaacagaagacatgttatcagtatggaatagggtctggatagaggaaaacccatggatggaggataagactcatgtgtccagttgggaagaagttccatacctaggaaagagggaagatcagtggtgtggatccctgataggcttaacagcaagggccacctgggccactaatatacaagtggccataaaccaagtgagaaggctcattgggaatgagaattatctagattacatgacatcaatgaagagattcaagaatgagagtgatcccgaaggggcactctggtaagtcaacacattcacaaaataaaggaaaataaaaaatcaaatgaggcaagaagtcaggccagattaagccatagtacggtaagagctatgctgcctgtgagccccgtccaaggacgtaaaatgaagtcaggccgaaagccacggtttgagcaagccgtgctgcctgtggctccatcgtggggatgtaaaaacccgggaggctgcaacccatggaagctgtacgcatggggtagcagactagtggttagaggagacccctcccaagacacaacgcagcagcggggcccaacaccaggggaagctgtaccctggtggtaaggactagaggttagaggagaccccccgcgtaacaataaacagcatattgacgctgggagagaccagagatcctgctgtctctacagcatcattccaggcacagaacgccagaaaatggaatggtgctgttgaatcaacaggttct

SEQ ID NO: 2 - protein, 3392 aa, Artificial Sequence
  Description of Artificial Sequence:/Note = synthetic construct
MINQRKKTGRPSFNMLKRARNRVSTVSQLAKRFSKGLLSGQGPMKLVMAFIAFLRFLAIPPTAGILARWGSFKKNGAIKVLRGFKREISNMLNIMNRRKRSVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNTTFIIDGPNTPECPDNQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDFCEGTTVVVDEHCGNRGPSLRTTTVTGKIIHEWCCRSCTLPPLRFKGEDGCWYGMEIRPVKDKEENLVKSMVSAGSGEVDSFSLGLLCISIMIEEVMRSRWSKKMLMTGTLAVFLLLIMGQLTWSDLIRLCIMVGANASDKMGMGTTYLALMATFKMRPMFAVGLLFRRLTSREVLLLTIGLSLVASVELPSSLEELGDGLAIGIMMLKLLTDFQSHQLWATLLSLTFIKTTFSLHYAWKTMAMVLSIVSLFPLCLSTTSQKTTWLPVLLGSLGCKPLPMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGVPIRYQTTAVKSEHTGKEIVDLMCHATFTMRLLSPVRVPNYNMIIMDEAHFTDPASIAARGYISTRVGMGEAAAIFMTATPPGSVEAFPQSNAIIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALYEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLHPASAWTLYAVATTIITPMMRHTIENTTANISLTAIANQAAILMGLDKGWPISKMDIGVPLLALGCYSQVNPLTLIAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWELVHRERELHKQGKCATCVYNMMGKREKKLGEFGKAKGSRAIWYMWLGARFLEFEALGFMNEDHWFSRENSLSGVEGEGLHKLGYILRDISRIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3 - DNA, 10735 bp, Artificial Sequence
  Description of Artificial Sequence:/Note = synthetic construct
  CDS (95)...(10273)
agttgttagtctacgtggaccgacaagaacagtttcgaatcggaagcttgcttaacgtagttctaacagttttttattagagagcagatctctgatgatcaaccaacgaaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcttaagatttctagccatacccccaacagcaggaattttggctagatggggctcattcaagaagaatggagcgattaaagtgttacggggtttcaagagagaaatctcaaacatgctaaacataatgaacaggaggaaaagatccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagctcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaaaagaaatcatggcttgtccacaaacagtggtttctagacttaccactgccttggacctctggggctttaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcggtgatgtgcatcgcagttggcatggtcacactgtacctaggagtcatggttcaggcagattcgggatgtgtaatcaactggaaaggcagagaacttaaatgtggaagcggcatttttgtcactaatgaagttcacacttggacagagcaatacaaattccaggctgactcccccaagagactatcagcagccattgggaaggcatgggaggagggtgtgtgtggaatccgatcagccactcgtctcgagaacatcatgtggaaacaaatatcaaatgaattgaaccacatcctacttgaaaatgacatgaaatttacagtggtcgtgggagacgttagtggaatcttggcccaagggaaaaaaatgattaggccacaacccatggaacacaaatactcgtggaaaagctggggaaaagctaaaatcataggagcggatgtacagaacaccaccttcatcatcgacggcccaaacaccccagaatgccctgacaatcaaagagcatggaatatttgggaagtagaggactatggatttgggattttcacgacaaacatatggttgaaattgcgtgactcctacacccaagtatgtgaccaccggctgatgtcagctgccattaaggacagcaaggcagtccatgctgacatggggtactggatagaaagtgaaaagaacgagacatggaagttggcgagagcctcctttatagaagttaagacatgcatctggccaaaatcccacactctatggagcaatggagttctggaaagtgaaatgataattccaaagatatatggaggaccaatatctcagcacaactacagaccaggatatttcacacaaacagcagggccgtggcacctaggcaagttggaactagatttcgatttttgtgaaggtaccacagttgttgtggatgaacattgtggaaatcgaggaccatctctcagaaccacaacagtcacaggaaagataatccatgaatggtgctgcagatcttgtacgctaccccccctacgtttcaaaggggaagacgggtgttggtacggcatggaaatcagaccagtgaaggacaaggaagagaacctggtcaagtcaatggtctctgcagggtcaggagaagtggacagcttttcactaggactgctatgcatatcaataatgattgaagaagtgatgagatccagatggagcaaaaaaatgctgatgactggaacactggctgtgttcctccttcttataatgggacaattgacatggagtgatctgatcaggttatgtattatggttggagccaacgcttcagacaagatggggatgggaacaacgtacctagctttaatggccactttcaaaatgagaccaatgttcgccgtcgggctattatttcgcagactaacatctagagaagttcttcttcttacaattggcttgagcctggtggcatccgtggagctaccaagttccctagaggagctgggggatggacttgcaataggcatcatgatgttgaaattattgactgattttcagtcacaccagctatgggctactctgctatccttgacatttattaaaacaactttttcattgcactatgcatggaagacaatggctatggtactgtcaattgtatctctcttccctttatgcctgtccacgacctctcaaaaaacaacatggcttccggtgctgttgggatctcttggatgcaaaccactacccatgtttcttataacagaaaacaaaatctggggaaggaagagttggcccctcaatgaaggaattatggctgttggaatagttagtattctactaagttcacttttaaaaaatgatgtgccgctagccggcccattaatagctggaggcatgctaatagcatgttatgtcatatccggaagctcagctgatttatcactggagaaagcggctgaggtctcctgggaggaagaagcagaacactcaggcgcctcacacaacatactagtagaggttcaagatgatggaaccatgaagataaaagatgaagagagagatgacacgctcaccattctccttaaagcaactctgctggcagtctcaggggtgtacccaatgtcaataccagcgaccctttttgtgtggtatttttggcagaaaaagaaacagagatcaggagtgctatgggacacacccagccccccagaagtggaaagagcagttcttgatgatggcatctatagaattttgcaaagaggactgttgggcaggtcccaagtaggagtaggagttttccaagaaggcgtgttccacacaatgtggcacgtcactaggggagctgtcctcatgtatcaaggaaaaaggctggaaccaagctgggccagtgtcaaaaaagacttgatctcatatggaggaggttggaggtttcaaggatcctggaacacgggagaagaagtacaggtgattgctgttgaaccgggaaaaaaccccaaaaatgtacaaacaacgccgggtaccttcaagacccctgaaggcgaagttggagccatagccttagactttaaacctggcacatctggatctcccatcgtaaacagagagggaaaaatagtaggtctttatggaaatggagtggtgacaacaagcggaacttacgttagtgccatagctcaagctaaggcatcacaagaagggcctctaccagagattgaggacaaggtgtttaggaaaagaaacttaacaataatggacctacatccaggatcgggaaaaacaagaagataccttccagccatagtccgtgaggccataaaaaggaagctgcgcacgctaatcctagctcccacaagagttgtcgcttctgaaatggcagaggcactcaagggagtgccaataaggtatcagacaacagcagtgaagagtgaacacacaggaaaggagatagttgaccttatgtgccacgccactttcaccatgcgcctcctgtctcccgtgagagttcccaattataacatgattatcatggatgaagcacacttcaccgatccagccagcatagcagccagagggtacatctcaacccgagtgggtatgggtgaagcagctgcgatctttatgacagccactcccccaggatcggtggaggcctttccacagagcaatgcaattatccaagatgaggaaagagacattcctgagagatcatggaactcaggctatgactggatcactgattttccaggtaaaacagtctggtttgttccaagcatcaaatcaggaaatgacattgccaactgtttaagaaaaaacgggaaacgggtgatccaattgagcagaaaaacctttgacactgagtaccagaaaacaaaaaacaacgactgggactatgtcgtcacaacagacatttccgaaatgggagcaaatttccgggccgacagggtaatagacccaaggcggtgtctgaaaccggtaatactaaaagatggtccagagcgcgtcattctagccggaccgatgccagtgactgtggccagtgccgcccagaggagaggaagaattggaaggaaccaaaacaaggaaggtgatcagtatatttacatgggacagcctttaaacaatgatgaggaccacgctcattggacagaagcaaagatgctccttgacaatataaacacaccagaagggattatcccagccctctttgagccggagagagaaaagagtgcagctatagacggggaatacagactgcggggtgaagcaaggaaaacgttcgtggagctcatgagaagaggggatctaccagtctggctatcctacaaagttgcctcagaaggcttccagtactccgacagaaggtggtgcttcgatggggaaaggaacaaccaggtgttggaggagaacatggacgtggagatctggacaaaagaaggagaaagaaagaaactacgacctcgctggttggacgccagaacatactctgacccactggctctgcgcgagtttaaagagtttgcagcaggaagaagaagcgtctcaggtgacctaatattagaaatagggaaacttccacaacatttgacgcaaagggcccagaatgctttggacaacttggtcatgttgcacaattccgaacaaggaggaaaagcctatagacatgctatggaagaactgccagacacaatagaaacgttgatgctcctagccttgatagctgtgttgactggtggagtgacgctgttcttcctatcaggaagaggtctaggaaaaacatctatcggcttactctgcgtgatggcctcaagcgcactgttatggatggccagtgtggagccccattggatagcggcctccatcatactggagttctttctgatggtactgcttattccagagccagacagacagcgcactccacaggacaaccagctagcatatgtggtgataggtctgttattcgtgatattgacagtggcagccaatgagatgggattattggaaaccacaaagaaagacctggggattggccatgtagctgctgaaaaccaccaccatgctacaatgctggacgtagacctacatccagcttcagcctggaccctctatgcagtggccacaacaatcatcactcctatgatgagacacacaattgaaaacacaacggcaaatatttccctgacagccatcgcaaaccaagcagctatattgatgggacttgacaagggatggccaatatcgaagatggacataggagttccacttctcgccttggggtgctattcccaagtgaatccgctgacactgatagcggcagtattgatgctagtagctcattacgccataattggacctggactgcaagcaaaagctactagagaagctcaaaaaagaacagcggctggaataatgaaaaatccaactgtcgacgggattgttgcaatagacttagatcccgtggtttacgatgcaaaatttgaaaaacagctaggccaaataatgttgttgatactttgcacatcacagattcttttgatgcggactacatgggccttgtgtgaatccatcacattggctactggacctctgaccactctttgggagggatctccaggaaaattctggaacaccacaatagcggtatccatggcaaacattttcagggggagttatctagcaggagcaggtctggccttctcattaatgaaatctctaggaggaggtaggagaggcacgggagcccaaggggaaacactgggagaaaaatggaaaagacaactaaaccaactgagcaagtcagaattcaatacttacaagaggagtgggattatggaggtggatagatccgaagccaaagagggactgaaaagaggagaaacaaccaaacacgcagtatcgagaggaacggccaaactgaggtggttcgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccaatcccaatggcgacctatggatggaacctagtaaagctgcactccggaaaagatgtattttttataccacctgagaaatgtgacacccttttgtgtgatattggtgagtcctctccgaacccaactatagaggaaggaagaacgttacgtgttctgaaaatggtggaaccatggctcagaggaaaccaattttgcataaaaattctaaatccctatatgccgagcgtggtagaaactctggaacaaatgcaaagaaaacatggaggaatgctagtgcgaaacccactctcaagaaattccacccatgaaatgtactgggtttcatgtggaacaggaaacattgtgtcagcagtaaacatgacatctagaatgttgctaaatcggttcacaatggctcacaggaagccaacatatgaaagagacgtggacttaggcgctggaacaagacatgtggcagtagaaccagaggtagccaacctagatatcattggccagaggatagagaatataaaaaatgaacataagtcaacatggcattatgatgaggacaatccatacaaaacatgggcctatcatggatcatatgaggttaagccatcaggatcggcctcatccatggtcaatggcgtggtgagattgctcaccaaaccatgggatgttatccccatggtcacacaaatagccatgactgataccacaccctttggacaacagagggtgtttaaagagaaagttgacacgcgcacaccaaaagcaaaacgtggcacagcacaaattatggaagtgacagccaggtggttatggggtttcctttctagaaacaaaaaacccagaatttgcacaagagaggagtttacaagaaaagttaggtcaaacgcagctattggagcagtgttcgttgatgaaaatcaatggaactcggcaaaagaagcagtggaagacgaacggttctgggaacttgtccacagagagagggagcttcataaacaggggaaatgtgccacgtgtgtctacaatatgatggggaagagagagaaaaaattaggagagttcggaaaggcaaaaggaagtcgtgcaatatggtacatgtggttgggagcacgcttcctagagtttgaagcccttggtttcatgaatgaagatcactggttcagtagagagaattcactcagtggagtggaaggagaaggactccacaaacttggatacatactcagagacatatcaaggattccaggggggaacatgtatgcagatgacacagccggatgggacacaagaataacagaggatgatctccagaatgaggctaaaatcactgacatcatggagcccgaacatgccctgctggctacgtcaatctttaagctgacctaccaaaataaggtggtaagggtgcagagaccagcaaaaaatggaaccgtgatggatgttatatccagacgtgaccagagaggcagtggacaggttggaacttatggcttaaacactttcaccaacatggaggcccaactgataagacaaatggagtctgagggaatctttttacccagcgaattggaaaccccaaatctagccggaagagttctcgactggttggaaaaatatggtgtcgaaaggctgaaaagaatggcaatcagcggagatgactgtgtggtgaaaccaattgatgacaggttcgcaacagccttaacagctttgaatgacatgggaaaagtaagaaaagacataccacaatgggaaccttcaaaaggatggaatgattggcaacaagtgcctttctgttcacaccacttccaccagctaattatgaaggatgggagggagatagtggtgccatgccgcaaccaagatgaacttgtggggagggccagagtatcacaaggcgccggatggagcctgagagaaaccgcatgcctaggcaagtcatatgcacaaatgtggcagctgatgtatttccacaggagagacctgagactggcggctaacgctatttgttcagccgttccagttgattgggtcccaaccagccgcaccacctggtcgatccatgcccatcaccaatggatgacaacagaagacatgttatcagtatggaatagggtctggatagaggaaaacccatggatggaggataagactcatgtgtccagttgggaagaagttccatacctaggaaagagggaagatcagtggtgtggatccctgataggcttaacagcaagggccacctgggccactaatatacaagtggccataaaccaagtgagaaggctcattgggaatgagaattatctagattacatgacatcaatgaagagattcaagaatgagagtgatcccgaaggggcactctggtaagtcaacacattcacaaaataaaggaaaataaaaaatcaaatgaggcaagaagtcaggccagattaagccatagtacggtaagagctatgctgcctgtgagccccgtccaaggacgtaaaatgaagtcaggccgaaagccacggtttgagcaagccgtgctgcctgtggctccatcgtggggatgtaaaaacccgggaggctgcaacccatggaagctgtacgcatggggtagcagactagtggttagaggagacccctcccaagacacaacgcagcagcggggcccaacaccaggggaagctgtaccctggtggtaaggactagaggttagaggagaccccccgcgtaacaataaacagcatattgacgctgggagagaccagagatcctgctgtctctacagcatcattccaggcacagaacgccagaaaatggaatggtgctgttgaatcaacaggttct

SEQ ID NO: 4 - protein, 3392 aa, Artificial Sequence
  Description of Artificial Sequence:/Note = synthetic construct
MINQRKKTGRPSFNMLKRARNRVSTVSQLAKRFSKGLLSGQGPMKLVMAFIAFLRFLAIPPTAGILARWGSFKKNGAIKVLRGFKREISNMLNIMNRRKRSVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIAQYENLKYSVIVTVHTGDQHQVGNETTEHGTTATITPQAPTSEIQLTDYGTLTLDCSPRTGLDFNEMVLLTMKKKSWLVHKQWFLDLPLPWTSGALTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSVMCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNTTFIIDGPNTPECPDNQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDFCEGTTVVVDEHCGNRGPSLRTTTVTGKIIHEWCCRSCTLPPLRFKGEDGCWYGMEIRPVKDKEENLVKSMVSAGSGEVDSFSLGLLCISIMIEEVMRSRWSKKMLMTGTLAVFLLLIMGQLTWSDLIRLCIMVGANASDKMGMGTTYLALMATFKMRPMFAVGLLFRRLTSREVLLLTIGLSLVASVELPSSLEELGDGLAIGIMMLKLLTDFQSHQLWATLLSLTFIKTTFSLHYAWKTMAMVLSIVSLFPLCLSTTSQKTTWLPVLLGSLGCKPLPMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDKVFRKRNLTIMDLHPGSGKTRRYLPAIVREAIKRKLRTLILAPTRVVASEMAEALKGVPIRYQTTAVKSEHTGKEIVDLMCHATFTMRLLSPVRVPNYNMIIMDEAHFTDPASIAARGYISTRVGMGEAAAIFMTATPPGSVEAFPQSNAIIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFVILTVAANEMGLLETTKKDLGIGHVAAENHHHATMLDVDLHPASAWTLYAVATTIITPMMRHTIENTTANISLTAIANQAAILMGLDKGWPISKMDIGVPLLALGCYSQVNPLTLIAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWELVHRERELHKQGKCATCVYNMMGKREKKLGEFGKAKGSRAIWYMWLGARFLEFEALGFMNEDHWFSRENSLSGVEGEGLHKLGYILRDISRIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 5 - DNA, 10723 bp, Artificial Sequence
  Description of Artificial Sequence:/Note = synthetic construct
  CDS (97)...(10272)
agttgttagtctacgtggaccgacaaagacagattctttgagggagctaagctcaatgtagttctaacagttttttaattagagagcagatctctgatgatcaaccaacgaaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcttaagatttctagccatacccccaacagcaggaattttggccagatggggctcattcaagaagaatggagcgattaaagtgttacggggtttcaagagagaaatctcaaacatgctaaacataatgaacaggaggaaaagatccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggttcctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcggtgatgtgcatcgcagccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 6 - protein, 3391 aa, Artificial Sequence
  Description of Artificial Sequence:/Note = synthetic construct
MINQRKKTGRPSFNMLKRARNRVSTVSQLAKRFSKGLLSGQGPMKLVMAFIAFLRFLAIPPTAGILARWGSFKKNGAIKVLRGFKREISNMLNIMNRRKRSVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSVMCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 7 - DNA, 10723 bp, Artificial Sequence
  Description of Artificial Sequence:/Note = synthetic construct
  CDS (97)...(10272)
agttgttagtctacgtggaccgacaaagacagattctttgagggagctaagctcaatgtagttctaacagttttttaattagagagcagatctctgatgatcaaccaacgaaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcttaagatttctagccatacccccaacagcaggaattttggctagatggggctcattcaagaagaatggagcgattaaagtgttacggggtttcaagagagaaatctcaaacatgctaaacataatgaacaggaggaaaagatccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagctcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaaaagaaatcatggcttgtccacaaacagtggttcctagacttaccactgccttggacctctggggctttaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcggtgatgtgcatcgcagccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 8 - protein, 3391 aa, Artificial Sequence
  Description of Artificial Sequence:/Note = synthetic construct
MINQRKKTGRPSFNMLKRARNRVSTVSQLAKRFSKGLLSGQGPMKLVMAFIAFLRFLAIPPTAGILARWGSFKKNGAIKVLRGFKREISNMLNIMNRRKRSVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIAQYENLKYSVIVTVHTGDQHQVGNETTEHGTTATITPQAPTSEIQLTDYGTLTLDCSPRTGLDFNEMVLLTMKKKSWLVHKQWFLDLPLPWTSGALTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSVMCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 9 - DNA, 10717 bp, Artificial Sequence
  Description of Artificial Sequence:/Note = synthetic construct
  CDS (97)...(10266)
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgatggagagccgcgcatgattgtggggaagaatgaaagaggaaaatccctacttttcaagacagcctctggaatcaacatgtgcacactcatagctatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctctcaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcggccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 10 - protein, 3389 aa, Artificial Sequence
  Description of Artificial Sequence:/Note = synthetic construct
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKALNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 11 - DNA, 10723 bp, Artificial Sequence
  Description of Artificial Sequence:/Note = synthetic construct
  CDS (97)...(10272)
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagctctgcaggcatgatcattatgctgattccaacagtgatggcgttccatttaaccacgcgtgatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacgtccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgtaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccctgtttggaggagtctcatggatgattagaatcctaattgggttcctagtgttgtggattggcacgaactcaaggaacacttcaatggctatgacgtgcatagctgccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 12 - protein, 3391 aa, Artificial Sequence
  Description of Artificial Sequence:/Note = synthetic construct
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRSSAGMIIMLIPTVMAFHLTTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTLFGGVSWMIRILIGFLVLWIGTNSRNTSMAMTCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 13 - DNA, 10723 bp, Artificial Sequence
  Description of Artificial Sequence:/Note = synthetic construct
  CDS (97)...(10272)
agttgttagtctacgtggaccgacaaagacagattctttgagggagctaagctcaacgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagagggcatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgctcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgttcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcggaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 14 - protein, 3391 aa, Artificial Sequence
  Description of Artificial Sequence:/Note = synthetic construct
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLLLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 15 - DNA, 10723 bp, Artificial Sequence
  Description of Artificial Sequence:/Note = synthetic construct
  CDS (97)...(10272)
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggttggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccatttggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgttgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 16 - protein, 3391 aa, Artificial Sequence
  Description of Artificial Sequence:/Note = synthetic construct
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEVGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 17 - DNA, 10756 bp, Artificial Sequence
  Description of Artificial Sequence:/Note = synthetic construct
  CDS (97)...(10305)
agttgttagtctacgtggaccgacaaagacagattctttgagggagctaagctcaacgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatccgcgggcaccggaattgcagtcatgattggcctgatcgccagcgtaggagcagttaccctctctaacttccaagggaaggtgatgatgacggtaaatgctactgacgtcacagatgtcatcacgattccaacagctgctggaaagaacctatgcattgtcagagcaatggatgtgggatacatgtgcgatgatactatcacttatgaatgcccagtgctgtcggctggtaatgatccagaagacatcgactgttggtgcacaaagtcagcagtctacgtcaggtatggaagatgcaccaagacacgccactcaagacgcagtcggaggtcactgacagtgcagacacacggagaaagcactctagcgaacaagaagggggcttggatggacagcaccaaggccacaaggtatttggtaaaaacagaatcatggatcttgaggaaccctggatatgccctggtggcagccgtcattggttggatgcttgggagcaacaccatgcagagagttgtgtttgtcgtgctattgcttttggtggccccagcttacagcttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtacgaagtggccatttttgtccatggaccaactactgtggagtcgcacggaaattactccacacaggttggagccactcaggcagggagattcagcatcactcctgcggcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccacacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaagcctttacaaccaccctcaaaggagcgcagagactagccgctctaggagacacagcttgggactttggatcagttggaggggtgttcacctcagttgggaaggctgtccatcaagtgttcggaggagcattccgctcactgttcggaggcatgtcctggataacgcaaggattgctgggggctctcctgttgtggatgggcatcaatgctcgtgataggtccatagctctcacgtttctcgcagccggcattgtgacactgtatttgggggtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagagggcatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgctcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgttcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcggaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 18 - protein, 3402 aa, Artificial Sequence
  Description of Artificial Sequence:/Note = synthetic construct
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGTGIAVMIGLIASVGAVTLSNFQGKVMMTVNATDVTDVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQVGATQAGRFSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGKAFTTTLKGAQRLAALGDTAWDFGSVGGVFTSVGKAVHQVFGGAFRSLFGGMSWITQGLLGALLLWMGINARDRSIALTFLAAGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLLLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 19 - DNA, 10699 bp, Artificial Sequence
  Description of Artificial Sequence:/Note = synthetic construct
  CDS (95)...(10267)
agttgttagtctacgtggaccgacaagaacagtttcgactcggaagcttgcttaacgtagtgctgacagttttttattagagagcagatctctgatgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcatttatagctttcctcagatttctagccattccaccgacagcaggagtcttggctagatggggtacctttaagaagtcgggggctattaaggtcttaaaaggcttcaagaaggagatctcaaacatgctgagcattatcaacaaacggaaaaagacatcgctctgtctcatgatgatgttaccagcaacacttgctttccacttaacttcacgagatggagagccgcgcatgattgtggggaagaatgaaagaggaaaatccctacttttcaagacagcctctggaatcaacatgtgcacactcatagccatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctcacaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcagactcccccaagagactggcaacagccattgcaggcgcttgggaaaatggagtgtgcggaattaggtcaacaaccagaatggagaacctcttgtggaagcaaatagccaatgaactgaattacatattatgggaaaacaacattaaattaacggtagttgtaggcgacataactggggtcttagagcaagggaaaagaacactaacaccacaacccatggagctaaaatattcttggaaaacatggggaaaggcaaaaatagtgacagctgaaacacaaaattcctctttcataatagatgggccaagcacaccggagtgtccaagtgcctcaagagcatggaatgtgtgggaggtggaggattacgggttcggagttttcacaaccaacatatggctgaaactccgagaggtgtacacccaactatgtgaccataggctaatgtcggcagccgtcaaggatgagagggctgtacatgccgacatgggctattggatagaaagccaaaagaatgggagttggaagctagaaaaagcatccttcatagaggtgaaaacctgcacatggccaaaatcacacactctctggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacggtgtcagggaagttgatacacgaatggtgctgccgctcgtgcacacttcctcccctacgatacatgggagaagacggctgctggtatggcatggaaatcagacccattaatgagaaagaagagaatatggtaaagtctctagcctcagcagggagtggaaaggtggacaacttcacaatgggtgtcttgtgtttggcaatcctctttgaagaggtgatgagaggaaaatttgggaaaaaacacatgattgcaggggttctcttcacgtttgtgctcctcctctcagggcaaataacatggagagacatggcgcacacactcataatgattgggtccaacgcctctgacagaatggggatgggcgtcacttacctagctctaattgcaacatttaaaattcagccattcctggctttgggattcttcctgaggaaactgacatctagagaaaatttattgctgggagttgggttggccatggcagcaacgttacgactgccagaggacattgaacagatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagctcaacccctaccactttttattttcagtctgaaagatacactcaaaaggagaagctggccactgaatgagggggtgatggcagttggacttgtgagcattctagctagttctctccttaggaatgatgtgcctatggctggaccattagtggctgggggcttgctgatagcgtgctacgtcataactggcacgtcagcagacctcactgtagaaaaagcagcagatgtaacatgggaggaagaggccgagcaaacaggagtgtcccacaatttaatggtcacagttgatgatgatggaacaatgagaataaaagatgacgagactgagaacatcttaacagtgcttttaaaaacagcactactaatagtatcaggcatctttccatactccatacccgcaacactgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcatgtcacaagaggggcagtgttgacacacaatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcatttttcagacaacaacaggggaaataggagcaattgcactggatttcaagcctggaacttcaggatctcccatcataaacagagagggaaaggtagtgggactgtatggcaatggagtggttacaaagaatggaggctatgtcagtggaatagcgcaaacaaatgcagaaccagatggaccgacaccagagttggaagaagagatgttcaaaaagcgaaatctaaccataatggatctccatcctgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacaggaagagagattgttgatctaatgtgtcacgcaacgttcacaatgcgcttgctgtcaccagtcagggttccaaactacaacttgataataatggatgaggcccatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagagagagacataccggaacgctcatggaattcaggcaatgaatggattactgactttgttgggaagacagtgtggtttgtccctagcatcaaagccggaaatgacatagcaaactgcttgcggaaaaatggaaaaaaggttattcaactcagcaggaagacctttgacacagaatatcaaaagaccaaactgaatgattgggactttgtggtgacaacagacatttcagaaatgggagccaatttcaaagcagatagagtgatcgacccaagaagatgtctcaagccggtgattttgacagatggacccgagcgggtgatcctggctggaccaatgccagtcaccgtagcgagcgctgcgcaaaggagagggagagttggcaggaacccacaaaaagaaaatgaccagtacatattcatgggccagcctctcaacaatgatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaaactgagacctaggtggcttgatgcccgcacttattcagatcctttagcactcaaagaattcaaggattttgcagctggcagaaagtcaatcgcccttgatcttgtgacagaaataggaagagtgccttcacacttagcccacagaacgagaaacgccctggataatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcatcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggatgtggacttgcacccagcatcagcctggacattgtacgccgtggccacaacagtaataacaccaatgttgagacacaccatagagaattccacagcaaatgtgtctctggcagccatagctaaccaggcagtggtcctgatgggtttagacaaaggatggccgatatcgaaaatggacttgggcgtaccactattggcactgggttgctattcacaagtgaacccactaactcttgcagcggcagtacttttgctagtcacacattatgcaattataggtccaggattgcaggcaaaagccacccgtgaagctcagaaaaggacagctgctggaataatgaagaatccaacggtggatggaataatgacaatagacctagatcctgtaatatatgattcaaaatttgaaaagcaactaggacaggtcatgctcctggttctgtgtgcagtccaacttttattgatgagaacatcatgggccttgtgtgaagttctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcctgaaggaagagtcatagacctaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagttttgaagatggttgaaccatggctaaagaacaaccagttttgcattaaagtattgaacccatacatgccaactgtgattgagcacttagaaagactacaaaggaaacatggaggaatgcttgtgagaaatccactctcacgaaactccacgcacgaaatgtattggatatccaatggtacaggcaatatcgtctcttcagtcaacatggtatccagattgctactgaacagattcacaatgacacacaggagacccaccatagagaaagatgtggatctaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccattcggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggaattcacaaagaaggtcagaaccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaaggcagtagggctatatggtacatgtggttgggagccaggtaccttgagttcgaggcgctcggattcctcaatgaagaccactggttctcgcgtgaaaactcttacagtggagtagaaggagaaggactgcacaagctgggatacatcttgagagatatttccaagatacccggaggagccatgtatgctgatgacacagccggttgggacacaagaataacagaagatgacctgcacaatgaggaaaaaatcacacagcagatggaccctgaacacaggcagctagcgaacgctatattcaagctcacataccaaaacaaagtggtcaaagtccaacgaccaactccaaagggcacggtaatggacatcatatctaggaaagaccaaagaggcagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggaaaggttaaaaagaatggccatcagcggggatgattgcgttgtgaaaccaatcgacgacagattcgccaatgccctgcttgccctgaacgatatgggaaaggttagaaaggacatacctcaatggcagccatcaaagggatggcatgattggcaacaggtccccttctgctcccaccactttcatgaattgatcatgaaagatggaagaaagttggtagttccctgcagaccccaggacgaactaataggaagagcgagaatctcccaaggagcaggatggagccttagagaaactgcatgtctagggaaagcctacgctcaaatgtgggctctcatgtattttcacagaagagatcttagactagcatccaacgccatatgttcagcagtaccagtccactgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctagggaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaaaagcaggaggtaaactgtcaggccacattaagccacagtacggaagaagctgtgcagcctgtgagccccgtccaaggacgttaaaagaagaagtcaggcccaaaagccacggtttgagcaaaccgtgctgcctgtagctccgtcgtggggacgtaaagcctgggaggctgcaaaccgtggaagctgtacgcacggtgtagcagactagtggttagaggagacccctcccatgacacaacgcagcagcggggcccgagcactgagggaagctgtacctccttgcaaaggactagaggttagaggagaccccccgcaaacaaaaacagcatattgacgctgggagagaccagagatcctgctgtctcctcagcatcattccaggcacagaacgccagaaaatggaatggtgctgttgaatcaacaggttctagt

SEQ ID NO: 20 - protein, 3390 aa, Artificial Sequence
  Description of Artificial Sequence:/Note = synthetic construct
MNNQRKKTGKPSINMLKRVRNRVSTGSQLAKRFSRGLLNGQGPMKLVMAFIAFLRFLAIPPTAGVLARWGTFKKSGAIKVLKGFKKEISNMLSIINKRKKTSLCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDITGVLEQGKRTLTPQPMELKYSWKTWGKAKIVTAETQNSSFIIDGPSTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVISENCGTRGPSLRTTTVSGKLIHEWCCRSCTLPPLRYMGEDGCWYGMEIRPINEKEENMVKSLASAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMAATLRLPEDIEQMANGIALGLMALKLITQFETYQLWTALVSLTCSNTIFTLTVAWRTATLILAGISLLPVCQSSSMRKTDWLPMTVAAMGAQPLPLFIFSLKDTLKRRSWPLNEGVMAVGLVSILASSLLRNDVPMAGPLVAGGLLIACYVITGTSADLTVEKAADVTWEEEAEQTGVSHNLMVTVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLAAAVLLLVTHYAIIGPGLQAKATREAQKRTAAGIMKNPTVDGIMTIDLDPVIYDSKFEKQLGQVMLLVLCAVQLLLMRTSWALCEVLTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHPLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 21 - DNA, 10699 bp, Artificial Sequence
  Description of Artificial Sequence:/Note = synthetic construct
  CDS (95)...(10267)
agttgttagtctacgtggaccgacaagaacagtttcgactcggaagcttgcttaacgtagtgctgacagttttttattagagagcagatctctgatgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcatttatagctttcctcagatttctagccattccaccgacagcaggagtcttggctagatggggtacctttaagaagtcgggggctattaaggtcttaaaaggcttcaagaaggagatctcaaacatgctgagcattatcaacaaacggaaaaagacatcgctctgtctcatgatgatgttaccagcaacacttgctttccacttaacttcacgagatggagagccgcgcatgattgtggggaagaatgaaagaggaaaatccctacttttcaagacagcctctggaatcaacatgtgcacactcatagctatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatcttattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaagggatgagctatgcaatgtgcttgggtagctttgtgttgaagaaagaagtctccgaaacgcagcatgggacaatactcattaaggttgagtacaaagggaaagatgcaccctgcaagattcctttctccacggaggatggacaaggaaaagctcacaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggctactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcagactcccccaagagactggcaacagccattgcaggcgcttgggaaaatggagtgtgcggaattaggtcaacaaccagaatggagaacctcttgtggaagcaaatagccaatgaactgaattacatattatgggaaaacaacattaaattaacggtagttgtaggcgacataactggggtcttagagcaagggaaaagaacactaacaccacaacccatggagctaaaatattcttggaaaacatggggaaaggcaaaaatagtgacagctgaaacacaaaattcctctttcataatagatgggccaagcacaccggagtgtccaagtgcctcaagagcatggaatgtgtgggaggtggaggattacgggttcggagttttcacaaccaacatatggctgaaactccgagaggtgtacacccaactatgtgaccataggctaatgtcggcagccgtcaaggatgagagggctgtacatgccgacatgggctattggatagaaagccaaaagaatgggagttggaagctagaaaaagcatccttcatagaggtgaaaacctgcacatggccaaaatcacacactctctggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacggtgtcagggaagttgatacacgaatggtgctgccgctcgtgcacacttcctcccctacgatacatgggagaagacggctgctggtatggcatggaaatcagacccattaatgagaaagaagagaatatggtaaagtctctagcctcagcagggagtggaaaggtggacaacttcacaatgggtgtcttgtgtttggcaatcctctttgaagaggtgatgagaggaaaatttgggaaaaaacacatgattgcaggggttctcttcacgtttgtgctcctcctctcagggcaaataacatggagagacatggcgcacacactcataatgattgggtccaacgcctctgacagaatggggatgggcgtcacttacctagctctaattgcaacatttaaaattcagccactcctggctttgggattcttcctgaggaaactgacatctagagaaaatttattgctgggagttgggttggccatggcagcaacgttacgactgccagaggacattgaacagatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagctcaacccctaccactttttattttcagtctgaaagatacactcaaaaggagaagctggccactgaatgagggggtgatggcagttggacttgtgagcattctagctagttctctccttaggaatgatgtgcctatggctggaccattagtggctgggggcttgctgatagcgtgctacgtcataactggcacgtcagcagacctcactgtagaaaaagcagcagatgtaacatgggaggaagaggccgagcaaacaggagtgtcccacaatttaatggtcacagttgatgatgatggaacaatgagaataaaagatgacgagactgagaacatcttaacagtgcttttaaaaacagcactactaatagtatcaggcatctttccatactccatacccgcaacactgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcatgtcacaagaggggcagtgttgacacacaatgggaaaagactggaaccaaactgggctagcgtgaaaaaagatctgatttcatacggaggaggatggagattgagtgcacaatggaaaaagggggaggaggtgcaggttattgccgtagagcctgggaagaacccaaagaactttcaaaccatgccaggcatttttcagacaacaacaggggaaataggagcaattgcactggatttcaagcctggaacttcaggatctcccatcataaacagagagggaaaggtagtgggactgtatggcaatggagtggttacaaagaatggaggctatgtcagtggaatagcgcaaacaaatgcagaaccagatggaccgacaccagagttggaagaagagatgttcaaaaagcgaaatctaaccataatggatctccatcctgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacaggaagagagattgttgatctaatgtgtcacgcaacgttcacaatgcgcttgctgtcaccagtcagggttccaaactacaacttgataataatggatgaggcccatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagagagagacataccggaacgctcatggaattcaggcaatgaatggattactgactttgttgggaagacagtgtggtttgtccctagcatcaaagccggaaatgacatagcaaactgcttgcggaaaaatggaaaaaaggttattcaactcagcaggaagacctttgacacagaatatcaaaagaccaaactgaatgattgggactttgtggtgacaacagacatttcagaaatgggagccaatttcaaagcagatagagtgatcgacccaagaagatgtctcaagccggtgattttgacagatggacccgagcgggtgatcctggctggaccaatgccagtcaccgtagcgagcgctgcgcaaaggagagggagagttggcaggaacccacaaaaagaaaatgaccagtacatattcatgggccagcctctcaacaatgatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaaactgagacctaggtggcttgatgcccgcacttattcagatcctttagcactcaaagaattcaaggattttgcagctggcagaaagtcaatcgcccttgatcttgtgacagaaataggaagagtgccttcacacttagcccacagaacgagaaacgccctggataatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcatcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggatgtggacttgcacccagcatcagcctggacattgtacgccgtggccacaacagtaataacaccaatgttgagacacaccatagagaattccacagcaaatgtgtctctggcagccatagctaaccaggcagtggtcctgatgggtttagacaaaggatggccgatatcgaaaatggacttgggcgtaccactattggcactgggttgctattcacaagtgaacccactaactcttgcagcggcagtacttttgctagtcacacattatgcaattataggtccaggattgcaggcaaaagccacccgtgaagctcagaaaaggacagctgctggaataatgaagaatccaacggtggatggaataatgacaatagacctagatcctgtaatatatgattcaaaatttgaaaagcaactaggacaggtcatgctcctggttctgtgtgcagtccaacttttattgatgagaacatcatgggccttgtgtgaagttctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcctgaaggaagagtcatagacctaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagttttgaagatggttgaaccatggctaaagaacaaccagttttgcattaaagtattgaacccatacatgccaactgtgattgagcacttagaaagactacaaaggaaacatggaggaatgcttgtgagaaatccactctcacgaaactccacgcacgaaatgtattggatatccaatggtacaggcaatatcgtctcttcagtcaacatggtatccagattgctactgaacagattcacaatgacacacaggagacccaccatagagaaagatgtggatctaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccattcggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggaattcacaaagaaggtcagaaccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaaggcagtagggctatatggtacatgtggttgggagccaggtaccttgagttcgaggcgctcggattcctcaatgaagaccactggttctcgcgtgaaaactcttacagtggagtagaaggagaaggactgcacaagctgggatacatcttgagagatatttccaagatacccggaggagccatgtatgctgatgacacagccggttgggacacaagaataacagaagatgacctgcacaatgaggaaaaaatcacacagcagatggaccctgaacacaggcagctagcgaacgctatattcaagctcacataccaaaacaaagtggtcaaagtccaacgaccaactccaaagggcacggtaatggacatcatatctaggaaagaccaaagaggcagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggaaaggttaaaaagaatggccatcagcggggatgattgcgttgtgaaaccaatcgacgacagattcgccaatgccctgcttgccctgaacgatatgggaaaggttagaaaggacatacctcaatggcagccatcaaagggatggcatgattggcaacaggtccccttctgctcccaccactttcatgaattgatcatgaaagatggaagaaagttggtagttccctgcagaccccaggacgaactaataggaagagcgagaatctcccaaggagcaggatggagccttagagaaactgcatgtctagggaaagcctacgctcaaatgtgggctctcatgtattttcacagaagagatcttagactagcatccaacgccatatgttcagcagtaccagtccactgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctagggaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaaaagcaggaggtaaactgtcaggccacattaagccacagtacggaagaagctgtgcagcctgtgagccccgtccaaggacgttaaaagaagaagtcaggcccaaaagccacggtttgagcaaaccgtgctgcctgtagctccgtcgtggggacgtaaagcctgggaggctgcaaaccgtggaagctgtacgcacggtgtagcagactagtggttagaggagacccctcccatgacacaacgcagcagcggggcccgagcactgagggaagctgtacctccttgcaaaggactagaggttagaggagaccccccgcaaacaaaaacagcatattgacgctgggagagaccagagatcctgctgtctcctcagcatcattccaggcacagaacgccagaaaatggaatggtgctgttgaatcaacaggttctagt

SEQ ID NO: 22 - protein, 3390 aa, Artificial Sequence
  Description of Artificial Sequence:/Note = synthetic construct
MNNQRKKTGKPSINMLKRVRNRVSTGSQLAKRFSRGLLNGQGPMKLVMAFIAFLRFLAIPPTAGVLARWGTFKKSGAIKVLKGFKKEISNMLSIINKRKKTSLCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMILLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLGSFVLKKEVSETQHGTILIKVEYKGKDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDITGVLEQGKRTLTPQPMELKYSWKTWGKAKIVTAETQNSSFIIDGPSTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVISENCGTRGPSLRTTTVSGKLIHEWCCRSCTLPPLRYMGEDGCWYGMEIRPINEKEENMVKSLASAGSGKVDNFTMGVLCLAILFEEVMRGKFGKKHMIAGVLFTFVLLLSGQITWRDMAHTLIMIGSNASDRMGMGVTYLALIATFKIQPLLALGFFLRKLTSRENLLLGVGLAMAATLRLPEDIEQMANGIALGLMALKLITQFETYQLWTALVSLTCSNTIFTLTVAWRTATLILAGISLLPVCQSSSMRKTDWLPMTVAAMGAQPLPLFIFSLKDTLKRRSWPLNEGVMAVGLVSILASSLLRNDVPMAGPLVAGGLLIACYVITGTSADLTVEKAADVTWEEEAEQTGVSHNLMVTVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWKKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLAAAVLLLVTHYAIIGPGLQAKATREAQKRTAAGIMKNPTVDGIMTIDLDPVIYDSKFEKQLGQVMLLVLCAVQLLLMRTSWALCEVLTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHPLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 23 - DNA, 10648 bp, Artificial Sequence
  Description of Artificial Sequence:/Note = synthetic construct
  CDS (102)...(10265)
agttgttagtctgtgtggaccgacaaggacagttccaaatcggaagcttgcttaacacagttctaacagtttgtttgaatagagagcagatctctggaaaaatgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaaaagatggggacagttgaagaaaaataaggccatcaggatactgattggattcaggaaggagataggccgcatgctgaacatcttgaacgggagaaaaaggtcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccggagtccccagcgagactagcgtctgcaatattgaatgcccacaaagatggggtctgtggaattagatcaaccacgaggctggaaaatgtcatgtggaagcaaataaccaacgagctaaattatgttctctgggaaggaggacatgacctcactgtagtggctggggatgtgaagggggtgttgaccaaaggcaagagagcactcacacccccagtgaatgatctgaaatattcatggaagacatggggaaaagcaaaaatcttcaccccagaagcaagaaatagcacatttttaatagacggaccagacacctccgaatgccccaatgaacgaagagcatggaactttcttgaggtggaagactatggatttggcatgttcacgaccaacatatggatgaaattccgagaaggaagttcagaagtgtgtgaccacaggttaatgtcagcggcaattaaagatcagaaagctgtgcatgctgacatgggttattggatagagagctcaaaaaaccagacctggcagatagagaaagcatctcttattgaagtgaaaacatgtctgtggcccaagacccacacattgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcgcaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtaacggccggacagggcacatcagaaactttttctatgggtctgttgtgcctgaccttgtttgtggaagaatgcttgaggagaagagtcactaggaaacacatgatattggttgtggtgatcactctttgtgccatcatcctaggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactggggctaattttgctaaaaatagtgacacattttgacaacacccaagtgggaaccttagccctttccttgaccttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttatttgggaaaactcaggttggagtagggatacacatggaaggtgtatttcacacaatgtggcatgtaacaagaggatcagtgatctgccatgagactgggagattggagccatcttgggctgacgtcaggaatgacatgatatcatacggtgggggatggagacttggagacaaatgggacaaagaagaagatgttcaggtcctcgccatagaaccaggaaaaaatcctaaacatgtccaaacgaaacccggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaaccttgattttggctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagagttccaaattacaacctcatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggattttgtggtcactacagacatatctgaaatgggggccaattttagagctgggagagtgatagaccctaggagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaaggaataaccaaattttagaagaaaacatggaggttgaaatttggactagagagggagaaaagaaaaagctaaggccaagatggttagatgcacgtgtatacgctgaccccatggctttgaaggattttaaggagtttgctagtggaaggaagagcataactctcgacatcctaacagagattgccagtttgccaacttacctttcctctagggccaagctcgcccttgataacatagtcatgctccacacaacagaaagaggagggagggcctaccaacacgccctgaacgaactcccggagtcactggaaacacttatgcttgtagctttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccattattggtctcatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcggccgtcctaatggggcttggaaaaggatggccgctccacagaatggacctcggtgtgccgctgttagcaatgggatgctattctcaagtgaacccaacaactttgacagcatccttagtcatgcttttagtccattatgcaataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaggtcatgctactcgtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacctggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagattagatggattgttgagagagggatggtaaagccaaaagggaaagttgtagatcttggctgtgggagaggaggatggtcttattacatggcgacgctcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaattattgggagaaggcttcagcgattgcaagaggagcacaaagaaacctggcattatgatcaggaaaacccatacagaacctgggcgtatcatggaagctatgaagctccttcgacaggctctgcatcctccatggtgaacggggtagtaaaactgctaacaaaaccttgggatgtggttccaatggtgacccagttagccatgacagacacaaccccttttgggcaacaaagagtgttcaaagagaaggtggataccagaacaccacaaccaaaacccggtacacgaatggttatgaccacgacagccaattggctgtgggccctccttgggaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaagaactgatcacggaacagatggccccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctggatgagaggtttggcacttccctcctcttcttgaacgacatgggaaaggtgaggaaagacattccgcagtgggaaccatctaagggatggaaaaactggcaagaggttcctttttgctcccaccactttcacaagatcttcatgaaggatggccgctcactagttgttccatgtagaaaccaggatgaactgatagggagagccagaatctcgcagggggctggatggagcttaagagaaacagcctgcctgggcaaagcttacgcccagatgtggtcgctcatgtacttccacagaagggatctgcgtttagcctccatggccatatgctcagcagttccaacggaatggtttccaacaagcagaacaacatggtcaatccacgctcatcatcagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcagaaacctgatcggaaaagaggaatacgtggattacatgccagtaatgaaaagatacagcgctccttcagagagtgaaggagttctgtaattaccaacaacaaacaccaaaggctattgaagtcaggccacttgtgccacggcttgagcaaaccgtgctgcctgtagctccgccaataatgggaggcgtgaaatccctagggaggccatgcgccacggaagctgtacgcgtggcatattggactagcggttagaggagacccctcccatcactgacaaaacgcagcaaaagggggcccgaagccaggaggaagctgtactcctggtggaaggactagaggttagaggagacccccccaacacaaaaacagcatattgacgctgggaaagaccagagatcctgctgtctctgcaacatcaatccaggcacagagcgaagcaagatggattggtgttgttgatccaacaggttct

SEQ ID NO: 24 - protein, 3387 aa, Artificial Sequence
  Description of Artificial Sequence:/Note = synthetic construct
MNQRKKVVRPPFNMLKRERNRVSTPQGLVKRFSTGLFSGKGPLRMVLAFITFLRVLSIPPTAGILKRWGQLKKNKAIRILIGFRKEIGRMLNILNGRKRSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSATNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVAIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTHFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVVPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 25 - DNA, 10648 bp, Artificial Sequence
  Description of Artificial Sequence:/Note = synthetic construct
  CDS (102)...(10265)
agttgttagtctgtgtggaccgacaaggacagttccaaatcggaagcttgcttaacacagttctaacagtttgtttgaatagagagcagatctctggaaaaatgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaaaagatggggacagttgaagaaaaataaggccatcaggatactgattggattcaggaaggagataggccgcatgctgaacatcttgaacgggagaaaaaggtcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatctgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaagaaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccggagtccccagcgagactagcgtctgcaatattgaatgcccacaaagatggggtctgtggaattagatcaaccacgaggctggaaaatgtcatgtggaagcaaataaccaacgagctaaattatgttctctgggaaggaggacatgacctcactgtagtggctggggatgtgaagggggtgttgaccaaaggcaagagagcactcacacccccagtgaatgatctgaaatattcatggaagacatggggaaaagcaaaaatcttcaccccagaagcaagaaatagcacatttttaatagacggaccagacacctccgaatgccccaatgaacgaagagcatggaactttcttgaggtggaagactatggatttggcatgttcacgaccaacatatggatgaaattccgagaaggaagttcagaagtgtgtgaccacaggttaatgtcagcggcaattaaagatcagaaagctgtgcatgctgacatgggttattggatagagagctcaaaaaaccagacctggcagatagagaaagcatctcttattgaagtgaaaacatgtctgtggcccaagacccacacattgtggagcaatggagtgctggaaagccagatgctcattccaaaatcatatgcgggccctttttcacaccacaattaccgccagggctatgccacgcaaaccgtgggcccatggcacttaggcaaattagagatagactttggagaatgccccggaacaacagtcgcaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtaacggccggacagggcacatcagaaactttttctatgggtctgttgtgcctgaccttgtttgtggaagaatgcttgaggagaagagtcactaggaaacacatgatattggttgtggtgatcactctttgtgccatcatcctaggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactggggctaattttgctaaaaatagtgacacattttgacaacacccaagtgggaaccttagccctttccttgaccttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttatttgggaaaactcaggttggagtagggatacacatggaaggtgtatttcacacaatgtggcatgtaacaagaggatcagtgatctgccatgagactgggagattggagccatcttgggctgacgtcaggaatgacatgatatcatacggtgggggatggagacttggagacaaatgggacaaagaagaagatgttcaggtcctcgccatagaaccaggaaaaaatcctaaacatgtccaaacgaaacccggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaaccttgattttggctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagagttccaaattacaacctcatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggattttgtggtcactacagacatatctgaaatgggggccaattttagagctgggagagtgatagaccctaggagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaaggaataaccaaattttagaagaaaacatggaggttgaaatttggactagagagggagaaaagaaaaagctaaggccaagatggttagatgcacgtgtatacgctgaccccatggctttgaaggattttaaggagtttgctagtggaaggaagagcataactctcgacatcctaacagagattgccagtttgccaacttacctttcctctagggccaagctcgcccttgataacatagtcatgctccacacaacagaaagaggagggagggcctaccaacacgccctgaacgaactcccggagtcactggaaacacttatgcttgtagctttactaggtgctatgacagcaggtatcttcctgtttttcatgcaagggaaaggaatagggaaattgtcaatgggtttgataaccattgcggtggctagtggcttgttctgggtagcagaaattcaaccccagtggatagcggcctcaatcatactagagttttttctcatggtactgttgataccggaaccagaaaaacaaaggaccccacaagacaatcaattgatctacgtcatattgaccattctcaccattattggtctcatagcagccaacgagatggggctgattgaaaaaacaaaaacggattttgggttttaccaggtaaaaacagaaaccaccatcctcgatgtggacttgagaccagcttcagcatggacgctctatgcagtagccaccacatttctgactcccatgctgagacacaccatagaaaacacgtcggccaacctatctctagcagccattgccaaccaggcggccgtcctaatggggcttggaaaaggatggccgctccacagaatggacctcggtgtgccgctgttagcaatgggatgctattctcaagtgaacccaacaactttgacagcatccttagtcatgctttcagtccattatgcaataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaggtcatgctactcgtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacctggcgggagctggactggctttttcactcataaagaatgtacaaacccctaggaggggaactgggaccacaggagagacactgggagagaagtggaagagacagctaaactcattatacagaaaagagtttgaagagtataaaagaagtggaatactagaagtggacaggactgaagccaagtctgccctgaaagatgggtctaaaatcaagcatgcagtatctagagggtccagtaagattagatggattgttgagagagggatggtaaagccaaaagggaaagttgtagatcttggctgtgggagaggaggatggtcttattacatggcgacgctcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaattattgggagaaggcttcagcgattgcaagaggagcacaaagaaacctggcattatgatcaggaaaacccatacagaacctgggcgtatcatggaagctatgaagctccttcgacaggctctgcatcctccatggtgaacggggtagtaaaactgctaacaaaaccttgggatgtggttccaatggtgacccagttagccatgacagacacaaccccttttgggcaacaaagagtgttcaaagagaaggtggataccagaacaccacaaccaaaacccggtacacgaatggttatgaccacgacagccaattggctgtgggccctccttgggaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaagaactgatcacggaacagatggccccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctggatgagaggtttggcacttccctcctcttcttgaacgacatgggaaaggtgaggaaagacattccgcagtgggaaccatctaagggatggaaaaactggcaagaggttcctttttgctcccaccactttcacaagatcttcatgaaggatggccgctcactagttgttccatgtagaaaccaggatgaactgatagggagagccagaatctcgcagggggctggatggagcttaagagaaacagcctgcctgggcaaagcttacgcccagatgtggtcgctcatgtacttccacagaagggatctgcgtttagcctccatggccatatgctcagcagttccaacggaatggtttccaacaagcagaacaacatggtcaatccacgctcatcatcagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcagaaacctgatcggaaaagaggaatacgtggattacatgccagtaatgaaaagatacagcgctccttcagagagtgaaggagttctgtaattaccaacaacaaacaccaaaggctattgaagtcaggccacttgtgccacggcttgagcaaaccgtgctgcctgtagctccgccaataatgggaggcgtgaaatccctagggaggccatgcgccacggaagctgtacgcgtggcatattggactagcggttagaggagacccctcccatcactgacaaaacgcagcaaaagggggcccgaagccaggaggaagctgtactcctggtggaaggactagaggttagaggagacccccccaacacaaaaacagcatattgacgctgggaaagaccagagatcctgctgtctctgcaacatcaatccaggcacagagcgaagcaagatggattggtgttgttgatccaacaggttct

SEQ ID NO: 26 - protein, 3387 aa, Artificial Sequence
  Description of Artificial Sequence:/Note = synthetic construct
MNQRKKVVRPPFNMLKRERNRVSTPQGLVKRFSTGLFSGKGPLRMVLAFITFLRVLSIPPTAGILKRWGQLKKNKAIRILIGFRKEIGRMLNILNGRKRSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKKKVVGRIISSTPLAENTNSATNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSHHNYRQGYATQTVGPWHLGKLEIDFGECPGTTVAIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTHFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLFWVAEIQPQWIAASIILEFFLMVLLIPEPEKQRTPQDNQLIYVILTILTIIGLIAANEMGLIEKTKTDFGFYQVKTETTILDVDLRPASAWTLYAVATTFLTPMLRHTIENTSANLSLAAIANQAAVLMGLGKGWPLHRMDLGVPLLAMGCYSQVNPTTLTASLVMLSVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNVQTPRRGTGTTGETLGEKWKRQLNSLYRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVVPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 27 - DNA, 10723 bp, Artificial Sequence
  Description of Artificial Sequence:/Note = synthetic construct
  CDS (97)...(10272)
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggttcctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 28 - protein, 3391 aa, Artificial Sequence
  Description of Artificial Sequence:/Note = synthetic construct
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 29 - RNA, 6 nt, Artificial Sequence
  Description of Artificial Sequence:/Note = synthetic construct
cuacgu

SEQ ID NO: 30 - RNA, 6 nt, Artificial Sequence
  Description of Artificial Sequence:/Note = synthetic construct
acguag

SEQ ID NO: 31 - DNA, 17 bp, Artificial Sequence
  Description of Artificial Sequence:/Note = synthetic construct
tagagagcagatctctg

SEQ ID NO: 32 - DNA, 32 bp, Artificial Sequence
  Description of Artificial Sequence:/Note = synthetic construct
tgtgaccatgccggctgcgatgcactcaccga

SEQ ID NO: 33 - DNA, 38 bp, Artificial Sequence
  Description of Artificial Sequence:/Note = synthetic construct
tgctggccacttaactacgcgtgatggagagccgcgca

SEQ ID NO: 34 - DNA, 33 bp, Artificial Sequence
  Description of Artificial Sequence:/Note = synthetic construct
tgtaatgatgccggccgcgatgcatgaaaatga

SEQ ID NO: 35 - DNA, 38 bp, Artificial Sequence
  Description of Artificial Sequence:/Note = synthetic construct
ggcgtttcacttgtcaacgcgtgatggcgaacccctca

SEQ ID NO: 36 - DNA, 36 bp, Artificial Sequence
  Description of Artificial Sequence:/Note = synthetic construct
agtgattccgccggcagctatgcacgtcatagccat

SEQ ID NO: 37 - DNA, 39 bp, Artificial Sequence
  Description of Artificial Sequence:/Note = synthetic construct
ggagcagttaccctctctacgcgtcaagggaaggtgatg

SEQ ID NO: 38 - DNA, 44 bp, Artificial Sequence
  Description of Artificial Sequence:/Note = synthetic construct
gaagagcagaactccgccggctgcgagaaacgtgagagctatgg

SEQ ID NO: 39 - protein, 28 aa, Artificial Sequence
  Description of Artificial Sequence:/Note = synthetic construct
SAGMIIMLIPTVMAFHLTTRQGKVMMTV

SEQ ID NO: 40 - protein, 8 aa, Artificial Sequence
  Description of Artificial Sequence:/Note = synthetic construct
QGKVMMTV

SEQ ID NO: 41 - DNA, 56 bp, Artificial Sequence
  Description of Artificial Sequence:/Note = synthetic construct
aattcaacgcgtacatccgcgggcaccggaattgcagtcatgattggcctgatggc

SEQ ID NO: 42 - protein, 32 aa, Artificial Sequence
  Description of Artificial Sequence:/Note = synthetic construct
SAGTGIAVMIGLIASVGAVTLSNFQGKVMMTV

SEQ ID NO: 43 - protein, 29 aa, Artificial Sequence
  Description of Artificial Sequence:/Note = synthetic construct
TGIAVMIGLIASVGAVTLSNFQGKVMMTV

SEQ ID NO: 44 - DNA, 26 bp, Artificial Sequence
  synthetic construct
ttcatattgagctatctttccttcta

SEQ ID NO: 45 - DNA, 20 bp, Artificial Sequence
  synthetic construct
gtgtgccaagtttaagtgtg

SEQ ID NO: 46 - DNA, 19 bp, Artificial Sequence
  synthetic construct
tggacggtgactatcactg

SEQ ID NO: 47 - DNA, 26 bp, Artificial Sequence
  synthetic construct
aagccatgatttctttttcattgtca

SEQ ID NO: 48 - DNA, 20 bp, Artificial Sequence
  synthetic construct
cagggctagattttaacgag

SEQ ID NO: 49 - DNA, 21 bp, Artificial Sequence
  synthetic construct
agtggtaagtctagaaaccac

SEQ ID NO: 50 - DNA, 24 bp, Artificial Sequence
  synthetic construct
tccacaaacagtggtttctagact

SEQ ID NO: 51 - DNA, 22 bp, Artificial Sequence
  synthetic construct
tgttgctgacaatgaaaaagaa

SEQ ID NO: 52 - DNA, 21 bp, Artificial Sequence
  synthetic construct
tccaagtctcttgggatgtta

SEQ ID NO: 53 - DNA, 23 bp, Artificial Sequence
  synthetic construct
tgggatgttaaagccccagaggt

SEQ ID NO: 54 - DNA, 21 bp, Artificial Sequence
  synthetic construct
tcatggcttgtccacaaacag

SEQ ID NO: 55 - DNA, 21 bp, Artificial Sequence
  synthetic construct
ccagtaaatcttgtctgttcc

SEQ ID NO: 56 - DNA, 23 bp, Artificial Sequence
  synthetic construct
cgtccctttcggtgatgtgcatc

SEQ ID NO: 57 - DNA, 20 bp, Artificial Sequence
  synthetic construct
attctgctgacatggctagg

SEQ ID NO: 58 - DNA, 19 bp, Artificial Sequence
  synthetic construct
tcctaggtacagtgtgacc

SEQ ID NO: 59 - DNA, 23 bp, Artificial Sequence
  synthetic construct
agattccactaacgtctcccacg

SEQ ID NO: 60 - DNA, 21 bp, Artificial Sequence
  synthetic construct
aattgaaccacatcctacttg

SEQ ID NO: 61 - DNA, 20 bp, Artificial Sequence
  synthetic construct
ttgtgttccatgggttgtgg

SEQ ID NO: 62 - DNA, 25 bp, Artificial Sequence
  synthetic construct
tatgattttagcttttccccagctt

SEQ ID NO: 63 - DNA, 19 bp, Artificial Sequence
  synthetic construct
gccacaacccatggaacac

SEQ ID NO: 64 - DNA, 20 bp, Artificial Sequence
  synthetic construct
atgaaggtggtgttctgtac

SEQ ID NO: 65 - DNA, 24 bp, Artificial Sequence
  synthetic construct
tcctaaacaccttgtcctcaatct

SEQ ID NO: 66 - DNA, 20 bp, Artificial Sequence
  synthetic construct
gctaaggcatcacaagaagg

SEQ ID NO: 67 - DNA, 19 bp, Artificial Sequence
  synthetic construct
cgatcctggatgtaggtcc

SEQ ID NO: 68 - DNA, 21 bp, Artificial Sequence
  synthetic construct
cagccctctttgagccggaga

SEQ ID NO: 69 - DNA, 20 bp, Artificial Sequence
  synthetic construct
aatataaacacaccagaagg

SEQ ID NO: 70 - DNA, 19 bp, Artificial Sequence
  synthetic construct
tccccgtctatagctgcac

SEQ ID NO: 71 - DNA, 25 bp, Artificial Sequence
  synthetic construct
tgtcaatatcacgaataacagacct

SEQ ID NO: 72 - DNA, 19 bp, Artificial Sequence
  synthetic construct
cacaggacaaccagctagc

SEQ ID NO: 73 - DNA, 19 bp, Artificial Sequence
  synthetic construct
aataatcccatctcattgg

SEQ ID NO: 74 - DNA, 26 bp, Artificial Sequence
  synthetic construct
atttgaaaaacagctaggccaaataa

SEQ ID NO: 75 - DNA, 20 bp, Artificial Sequence
  synthetic construct
cttagatcccgtggtttacg

SEQ ID NO: 76 - DNA, 22 bp, Artificial Sequence
  synthetic construct
aatctgtgatgtgcaaagtatc

SEQ ID NO: 77 - DNA, 25 bp, Artificial Sequence
  synthetic construct
aaagattccctcagactccatttgt

SEQ ID NO: 78 - DNA, 20 bp, Artificial Sequence
  synthetic construct
cactttcaccaacatggagg

SEQ ID NO: 79 - DNA, 19 bp, Artificial Sequence
  synthetic construct
cgagaactcttccggctag

SEQ ID NO: 80 - DNA, 24 bp, Artificial Sequence
  synthetic construct
agctaagctcaatgtagtctaaca

SEQ ID NO: 81 - DNA, 19 bp, Artificial Sequence
  synthetic construct
cgtggaccgacaaagacag

SEQ ID NO: 82 - DNA, 20 bp, Artificial Sequence
  synthetic construct
tcatcagagatctgctctct

SEQ ID NO: 83 - DNA, 24 bp, Artificial Sequence
  synthetic construct
atgttcacgccaacctctgtttta

SEQ ID NO: 84 - DNA, 19 bp, Artificial Sequence
  synthetic construct
gatcgtcagcagacaagag

SEQ ID NO: 85 - DNA, 20 bp, Artificial Sequence
  synthetic construct
caattcaccaaggtccatgg

SEQ ID NO: 86 - DNA, 23 bp, Artificial Sequence
  synthetic construct
aacctccatttggagacagctac

SEQ ID NO: 87 - DNA, 22 bp, Artificial Sequence
  synthetic construct
aattgtgacagaaaaagatagc

SEQ ID NO: 88 - DNA, 19 bp, Artificial Sequence
  synthetic construct
tcagttgtcccggctctac

SEQ ID NO: 89 - DNA, 24 bp, Artificial Sequence
  synthetic construct
attccacaaatgtcctcttcatgg

SEQ ID NO: 90 - DNA, 21 bp, Artificial Sequence
  synthetic construct
tacaagttccaaccagaatcc

SEQ ID NO: 91 - DNA, 20 bp, Artificial Sequence
  synthetic construct
catcagattctccagtcttg

SEQ ID NO: 92 - DNA, 24 bp, Artificial Sequence
  synthetic construct
tttccccactgttcttaacatcct

SEQ ID NO: 93 - DNA, 22 bp, Artificial Sequence
  synthetic construct
gaaagtgagttgcacaatattg

SEQ ID NO: 94 - DNA, 21 bp, Artificial Sequence
  synthetic construct
atgctaatggtatccaatctg

SEQ ID NO: 95 - DNA, 21 bp, Artificial Sequence
  synthetic construct
catcagagctgagcacaccgg

SEQ ID NO: 96 - DNA, 21 bp, Artificial Sequence
  synthetic construct
catcagagctgtgcacaccgg

SEQ ID NO: 97 - DNA, 21 bp, Artificial Sequence
  synthetic construct
ccttagaggacttccaataag

SEQ ID NO: 98 - DNA, 21 bp, Artificial Sequence
  synthetic construct
aatgtggcatgacacattagg

SEQ ID NO: 99 - DNA, 23 bp, Artificial Sequence
  synthetic construct
atccctgaacgctcgtggaattc

SEQ ID NO: 100 - DNA, 21 bp, Artificial Sequence
  synthetic construct
agagcaatgcaccaatcatag

SEQ ID NO: 101 - DNA, 20 bp, Artificial Sequence
  synthetic construct
gaacgaaccaaacagtcttc

SEQ ID NO: 102 - DNA, 22 bp, Artificial Sequence
  synthetic construct
tatgccccttgcgctcatcaag

SEQ ID NO: 103 - DNA, 19 bp, Artificial Sequence
  synthetic construct
cacttctggctacagtcac

SEQ ID NO: 104 - DNA, 20 bp, Artificial Sequence
  synthetic construct
gtgattatgcagcacattcc

SEQ ID NO: 105 - DNA, 22 bp, Artificial Sequence
  synthetic construct
cttgggacgttgtccccatggt

SEQ ID NO: 106 - DNA, 20 bp, Artificial Sequence
  synthetic construct
cagcatcatccatggtcaac

SEQ ID NO: 107 - DNA, 19 bp, Artificial Sequence
  synthetic construct
ggagtcgtgtctgtcattg

SEQ ID NO: 108 - DNA, 23 bp, Artificial Sequence
  synthetic construct
cactcatagctatggatctggga

SEQ ID NO: 109 - DNA, 20 bp, Artificial Sequence
  synthetic construct
cttttcaagacagcctctgg

SEQ ID NO: 110 - DNA, 20 bp, Artificial Sequence
  synthetic construct
catttgtaagtgaccgtgtc

SEQ ID NO: 111 - DNA, 27 bp, Artificial Sequence
  synthetic construct
caatgaaatgatctcattgacaatgaa

SEQ ID NO: 112 - DNA, 19 bp, Artificial Sequence
  synthetic construct
aatgctcaccacggacagg

SEQ ID NO: 113 - DNA, 21 bp, Artificial Sequence
  synthetic construct
ttgtctatgtaccatccatgc

SEQ ID NO: 114 - DNA, 23 bp, Artificial Sequence
  synthetic construct
catagctcatccctttgagttcc

SEQ ID NO: 115 - DNA, 19 bp, Artificial Sequence
  synthetic construct
gaggcacaagtatctttgc

SEQ ID NO: 116 - DNA, 21 bp, Artificial Sequence
  synthetic construct
tttcttcaacacaaagctacc

SEQ ID NO: 117 - DNA, 24 bp, Artificial Sequence
  synthetic construct
acacaaagctacccaagcacattg

SEQ ID NO: 118 - DNA, 22 bp, Artificial Sequence
  synthetic construct
gatggacaaattggaactcaaa

SEQ ID NO: 119 - DNA, 20 bp, Artificial Sequence
  synthetic construct
atcttgcagggtgcatcttt

SEQ ID NO: 120 - DNA, 23 bp, Artificial Sequence
  synthetic construct
agggtgcatctttccctttgtac

SEQ ID NO: 121 - DNA, 19 bp, Artificial Sequence
  synthetic construct
gcagcatgggacaatactc

SEQ ID NO: 122 - DNA, 20 bp, Artificial Sequence
  synthetic construct
gtgatcagtctgccattgtg

SEQ ID NO: 123 - DNA, 25 bp, Artificial Sequence
  synthetic construct
cctctggcagtagcctcgaacatct

SEQ ID NO: 124 - DNA, 20 bp, Artificial Sequence
  synthetic construct
actggtacaagaagggaagc

SEQ ID NO: 125 - DNA, 19 bp, Artificial Sequence
  synthetic construct
acccactgatccaaagtcc

SEQ ID NO: 126 - DNA, 21 bp, Artificial Sequence
  synthetic construct
tcagccactcctggctttggg

SEQ ID NO: 127 - DNA, 19 bp, Artificial Sequence
  synthetic construct
ggcgtcacttacctagctc

SEQ ID NO: 128 - DNA, 20 bp, Artificial Sequence
  synthetic construct
tagatgtcagtttcctcagg

SEQ ID NO: 129 - DNA, 22 bp, Artificial Sequence
  synthetic construct
cctccccctttttccattgtgc

SEQ ID NO: 130 - DNA, 20 bp, Artificial Sequence
  synthetic construct
tttcatacggaggaggatgg

SEQ ID NO: 131 - DNA, 19 bp, Artificial Sequence
  synthetic construct
aggctctacggcaataacc

SEQ ID NO: 132 - DNA, 23 bp, Artificial Sequence
  synthetic construct
caacagtacatctgccggagaga

SEQ ID NO: 133 - DNA, 21 bp, Artificial Sequence
  synthetic construct
gagagccttatctaaaagagg

SEQ ID NO: 134 - DNA, 20 bp, Artificial Sequence
  synthetic construct
cttttccaaacaagccacag

SEQ ID NO: 135 - DNA, 26 bp, Artificial Sequence
  synthetic construct
aaccacttttttcttgttcacatctc

SEQ ID NO: 136 - DNA, 19 bp, Artificial Sequence
  synthetic construct
tggagctccgtgtaaagtc

SEQ ID NO: 137 - DNA, 20 bp, Artificial Sequence
  synthetic construct
gcactgttggtattctcagc

SEQ ID NO: 138 - DNA, 24 bp, Artificial Sequence
  synthetic construct
ccctttttcacaccacaattaccg

SEQ ID NO: 139 - DNA, 20 bp, Artificial Sequence
  synthetic construct
gaaagccagatgctcattcc

SEQ ID NO: 140 - DNA, 22 bp, Artificial Sequence
  synthetic construct
tatctctaatttgcctaagtgc

SEQ ID NO: 141 - DNA, 22 bp, Artificial Sequence
  synthetic construct
ctacccagaacaagccactagc

SEQ ID NO: 142 - DNA, 22 bp, Artificial Sequence
  synthetic construct
attgtcaatgggtttgataacc

SEQ ID NO: 143 - DNA, 20 bp, Artificial Sequence
  synthetic construct
tatgattgaggccgctatcc

SEQ ID NO: 144 - DNA, 25 bp, Artificial Sequence
  synthetic construct
tagtcatgctttcagtccattatgc

SEQ ID NO: 145 - DNA, 21 bp, Artificial Sequence
  synthetic construct
agtgaacccaacaactttgac

SEQ ID NO: 146 - DNA, 19 bp, Artificial Sequence
  synthetic construct
tggcttttgcctgcaatcc

SEQ ID NO: 147 - protein, 5 aa, Artificial Sequence
  synthetic construct
GAGKT

SEQ ID NO: 148 - protein, 5 aa, Artificial Sequence
  synthetic construct
GRIGR

We claim:

1. A nucleic acid chimera comprising a first nucleotide sequence encoding nonstructural proteins from attenuated dengue-2 virus vaccine strain PDK-53, and a second nucleotide sequence encoding a structural protein from a second flavivirus, wherein the structural protein is selected from the group consisting of an E protein of dengue-3 virus, a C protein of dengue-3 virus with an E protein of dengue-3 virus, and a prM protein of dengue-3 virus with an E protein of dengue-3 virus, and wherein the E protein of dengue-3 virus contains a leucine at amino acid position 345.

2. A nucleic acid chimera comprising a first nucleotide sequence encoding nonstructural proteins from attenuated dengue-2 virus vaccine strain PDK-53, and a second nucleotide sequence encoding a structural protein from a second flavivirus, wherein the structural protein is selected from the group consisting of an E protein of dengue-4 virus, a C protein of dengue-4 virus with an E protein of dengue-4 virus, and a prM protein of dengue-4 virus with an E protein of dengue-4 virus, and wherein the E protein of dengue-4 virus contains a leucine at amino acid position 447.

3. The nucleic acid chimera of claim 2, further comprising a C protein of dengue-2 virus and the C protein contains a serine at position 100.

4. The nucleic acid chimera of claim 3, further comprising a valine at position 364 of the E protein.

5. A nucleic acid chimera comprising a first nucleotide sequence encoding nonstructural proteins from attenuated dengue-2 virus vaccine strain PDK-53, and a second nucleotide sequence encoding a structural protein from a second flavivirus, wherein the structural protein is selected from the group consisting of a C protein of dengue-3 virus, a prM protein of dengue-3 virus, an E protein of dengue-3 virus or any combination thereof, and wherein the E protein contains a leucine at position 345.

6. A nucleic acid chimera comprising a first nucleotide sequence encoding nonstructural proteins from attenuated dengue-2 virus vaccine strain PDK-53, and a second, nucleotide sequence encoding a structural protein from a second flavivirus, wherein the structural protein is selected from the group consisting of a C protein of dengue-4 virus, a prM protein of dengue-4 virus, an E protein of dengue-4 virus or any combination thereof, wherein the E protein of dengue-4 virus contains a leucine at amino acid position 447 and a valine at position 364, and wherein the nucleic acid chimera further comprises a C protein of dengue-2 virus and the C protein of dengue-2 virus contains a serine at position 100.

* * * * *